(12) United States Patent
Hinkle et al.

(10) Patent No.: US 9,944,671 B2
(45) Date of Patent: Apr. 17, 2018

(54) COMPOSITIONS AND METHODS DIRECTED TO TREATING LIVER FIBROSIS

(75) Inventors: Greg Hinkle, Cambridge, MA (US); Victor Kotelianski, Cambridge, MA (US); Brian Bettencourt, Cambridge, MA (US); Alfica Sehgal, Cambridge, MA (US); Tatiana Novobrantseva, Cambridge, MA (US)

(73) Assignee: ALNYLAM PHARMACEUTICALS, INC., Cambridge, MA (US)

(*) Notice: Subject to any disclaimer, the term of this patent is extended or adjusted under 35 U.S.C. 154(b) by 0 days.

(21) Appl. No.: 13/701,551

(22) PCT Filed: Jun. 2, 2011

(86) PCT No.: PCT/US2011/038889
§ 371 (c)(1),
(2), (4) Date: Feb. 26, 2013

(87) PCT Pub. No.: WO2011/153323
PCT Pub. Date: Dec. 8, 2011

(65) Prior Publication Data
US 2013/0158097 A1 Jun. 20, 2013

Related U.S. Application Data

(60) Provisional application No. 61/350,829, filed on Jun. 2, 2010, provisional application No. 61/371,481, filed on Aug. 6, 2010, provisional application No. 61/408,271, filed on Oct. 29, 2010.

(51) Int. Cl.
| | |
|---|---|
| C12N 15/11 | (2006.01) |
| C12N 15/113 | (2010.01) |
| C07H 21/02 | (2006.01) |
| C07K 14/495 | (2006.01) |
| C07K 14/78 | (2006.01) |
| C07K 14/47 | (2006.01) |

(52) U.S. Cl.
CPC ......... *C07H 21/02* (2013.01); *C07K 14/4705* (2013.01); *C07K 14/495* (2013.01); *C07K 14/78* (2013.01); *C12N 15/113* (2013.01); *C12N 2310/14* (2013.01)

(58) Field of Classification Search
None
See application file for complete search history.

(56) References Cited

U.S. PATENT DOCUMENTS

2004/0234999 A1  11/2004  Farrar
2007/0031844 A1*  2/2007  Khvorova et al. ............... 435/6

FOREIGN PATENT DOCUMENTS

| WO | 2003035083 A1 | 5/2003 |
| WO | 2006068232 A1 | 6/2006 |
| WO | 2007133800 A1 | 11/2007 |
| WO | WO 2010/148050 A2 | 12/2010 |
| WO | WO 2010/148050 A3 | 12/2010 |

OTHER PUBLICATIONS

Chu et al, "Human alpha-1 collagen I gene, exon 1", Genbank Accession M10627(online), http://www.ncbi.nlm.nih.gov/nuccore/M10627, p. 1, 2004.
Van De Bovencamp, et al., "Precision-cut fibrotic rat liver slices as a new model to test the effects of anti-fibrotic drugs and vitro", Journal of Hepatology, vol. 45, pp. 696-7103, 2006.
Inagaki, Y. et al., Gut. 56(2):284-292 (Feb. 2007). "Emerging insights into Transforming growth factor beta Smad signal in hepatic fibrogenesis."
Koilan, S. et al., Oligonucleotides. 20(5):231-237 (Oct. 2010). doi: 10.1089/oli.2010.0244. Epub Sep. 6, 2010. "Prevention of liver fibrosis by triple helix-forming oligodeoxyribonucleotides targeted to the promoter region of type I collagen gene."
Laptev, A.V. et al. Biochemistry. 33(36):11033-11039 (Sep. 13, 1994). "Specific inhibition of expression of a human collagen gene (COL1A1) with modified antisense oligonucleotides. The most effective target sites are clustered in double-stranded regions of the predicted secondary structure for the mRNA."
Millington-Ward S. et al., Eur J Hum Genet. 12(10):864-866 (Oct. 2004). "RNAi of COL1A1 in mesenchymal progenitor cells."
Wang, Q. et al., Exp Dermatol. 16(7):611-617 (Jul. 2007). "RNAi-mediated inhibition of COL1A1 and COL3A1 in human skin fibroblasts."
Lu et al., "Construction of COL1A1-shRNA expression plasmid and screening of effective sequences to inhibit expression", World Chinese J of Digestology, 16(15):1622-1627 (2008) COL1A1.
Wang et al. Exp. Dermatol.,"RNAi-mediated inhibition of COL1A1 and COL3A1 in human skin fibroblasts" 16 (7):611-617 (2007).
Strausberg et al., Accession No. BC036531, Definition: Homo sapiens collagen, type I, alpha 1, mRNA (cDNA clone MGC:33668IMAGE:5264710), complete cds., Database DDBJ/EMBL/Genbank [online], (2006).
Garcia-Treviano et al., "Transforming growth factor beta1 induces the expression of alpha1(I) procollagen mRNA by a hydrogen peroxide-C/EBPbeta-dependent mechanism in rat hepatic stellate cells." Hepatology, 29(3):960-970 (1999).
Database EMBL[online] Dec. 25, 2009, "Sequence 220304 from patent U.S. Pat. No. 7618814", retrieved from EBI accession No. EM_Pat: GV220304 Database accession No. FV220304.
Collingwood et al., "Chemical modification patterns compatible with high potency dicer-substrate small interfering Oligonucleotides,18(2):187-200 (2008) RNAs".
Love et al., "Lipid-like materials for low-dose, in vivo gene silencing", Proc. Natl. Acad. Sci. U.S.A 107(5):1864-1869 (2010).
Jiang et al., "Changes in the gene expression associated with carbon tetrachloride-induced liver fibrosis persist after cessation of dosing in mice", Toxicol Sci. 79(2):404-410 (2004).
Lu et a., "Grading and staging of hepatic fibrosis, and its relationship with noninvasive diagnostic parameters", World J Gastroenterol. 9(11):2574-2578 (2003).
Sato et al., "Resolution of liver cirrhosis using vitamin A-coupled liposomes to deliver siRNA against a collagen-specific chaperone", Nat Biotechnol. 26(4):431-442. (2008).
Uemura et al., "mad2 and Smad3 play different roles in rat hepatic stellate cell function and alpha-smooth muscle actin organization", Mol Biol Cell. 6(9):4214-4124 (2005).

* cited by examiner

*Primary Examiner* — Jennifer Pitrak McDonald
(74) *Attorney, Agent, or Firm* — Nixon Peabody LLP; Mark J. FitzGerald; Srividya Subramanian

(57) ABSTRACT

The invention relates to double-stranded ribonucleic acid (dsRNA) compositions targeting the COL1A1, TGF-β, and SMAD2/3 genes, and methods of using such dsRNA compositions to inhibit expression of COL1A1, TGF-β, and SMAD2/3.

8 Claims, 19 Drawing Sheets

EVALUATION OF AF09 & AF12 FOR Col1a1 KNOCK-DOWN IN CCl$_4$ MOUSE MODEL

— EXPERIMENT:
- INDUCE LIVER INJURY USING CCl$_4$ BY ORAL GAVAGE (2X)   ON DAY1 & DAY8
  — FINAL DOSE 1.75ml/Kg
- IV INJECT MICE WITH FORMULATED siRNAs           ON DAY9
- SACRIFICE AT 40 HOURS POST siRNA INJECTION      ON DAY11

- ANALYZE Col1a1 AND GAPDH mRNA LEVELS IN LIVER USING TAQMAN-QPCR

— siCol1a1 (AD21349), siLUC (AD1955) DOSE: 3mg/Kg
— N=10-15

DOSE RESPONSE FOR Col1a1 KNOCK-DOWN WITH AF12 IN $CCl_4$ MOUSE MODEL

— EXPERIMENT:
- INDUCE LIVER INJURY USING $CCl_4$ BY ORAL GAVAGE (2X)  ON DAY1 & DAY8
  — FINAL DOSE 1.75ml/Kg
- IV INJECT MICE WITH FORMULATED siRNAs       ON DAY9
- SACRIFICE AT 40 HOURS POST siRNA INJECTION  ON DAY11
- ANALYZE Col1a1 AND GAPDH mRNA LEVELS IN LIVER USING TAQMAN-QPCR

— siCol1a1 (AD21349) DOSE: 0.1, 0.5, 1, 3mg/Kg
— siLUC (AD1955) DOSE: 3mg/Kg
— 10 ANIMALS PER EXPERIMENTAL GROUP (5 FOR MINERAL OIL)

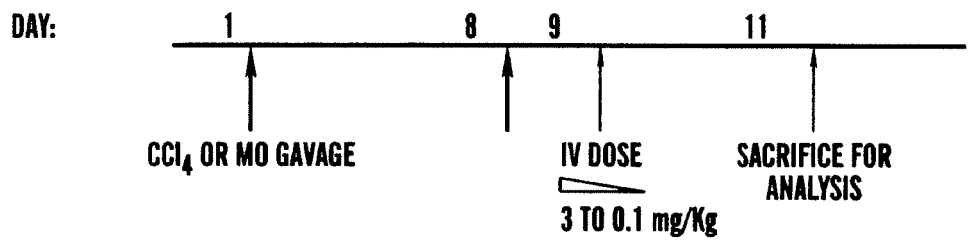

*FIG. 4*

EVALUATION OF AF-11 FOR Col1a1 KNOCK-DOWN IN $CCl_4$ MOUSE MODEL

- EXPERIMENT:
  - INDUCE LIVER INJURY USING $CCl_4$ BY ORAL GAVAGE (2X) ON DAY1 & DAY7
    - FINAL DOSE 1.75ml/Kg
  - IV INJECT MICE WITH FORMULATED siRNAs ON DAY8
  - SACRIFICE AT 40 HOURS POST siRNA INJECTION ON DAY10

- ANALYZE Col1a1 AND GAPDH mRNA LEVELS IN LIVER USING TAQMAN-QPCR

- siCol1a1 (AD21349), siLUC (AD1955) DOSE: 3mg/Kg
- STARTED WITH 10 ANIMALS PER EXPERIMENTAL GROUP (5 FOR MINERAL OIL)

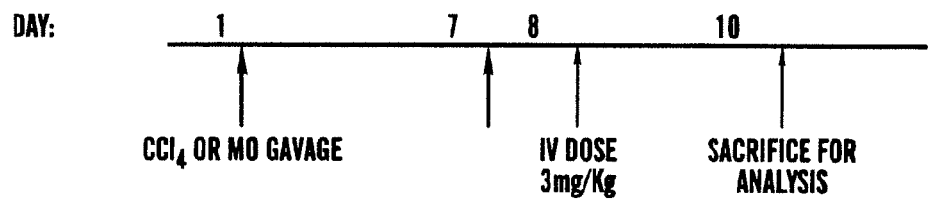

FIG. 6

CONFIRM DELIVERY TO STELLATE CELLS WITH ALPHA-SMOOTH MUSCLE ACTIN (α-SMA). α-SMA IS ABSENT IN HEPATOCYTES; IT IS PRESENT IN ACTIVATED STELLATE CELLS AND VASCULAR SMOOTH MUSCLE CELLS. CCl₄ TREATMENT INDUCES α-SMA. FORMULATED siRNA AGAINST α-SMA DECREASES α-SMA LEVELS BY 70% AS AGAINST THE CONTROL Luc siRNA.

Col1a1 KNOCKDOWN IS MEDIATED BY RNAi. 10 animals were given $CCl_4$ BY ORAL GAVAGE. (A) SCHEME FOR 5'RACE ASSAY. TOTAL LIVER mRNA WAS PROCESSED USING GENERACER KIT (INVITROGEN) FOR cDNA SYNTHESIS AND 5'RACE to analyze the cleaved col1a1. THE PCR PRODUCTS WERE CLONED INTO TA VECTORS AND SEQUENCED. (B) ANIMALS WERE INJECTED WITH C12-200-siCol1a1 AND SACRIFICED AFTER 24 HOURS. (C) AGAROSE GEL SHOWING DNA BANDS FOR NESTED PCR. 80% OF THE CLONES FROM C12-200-Col1a1 GROUP SHOWED EXPECTED CLEAVAGE PRODUCT (AT POSITION 9 OF THE siRNA SEQUENCE).

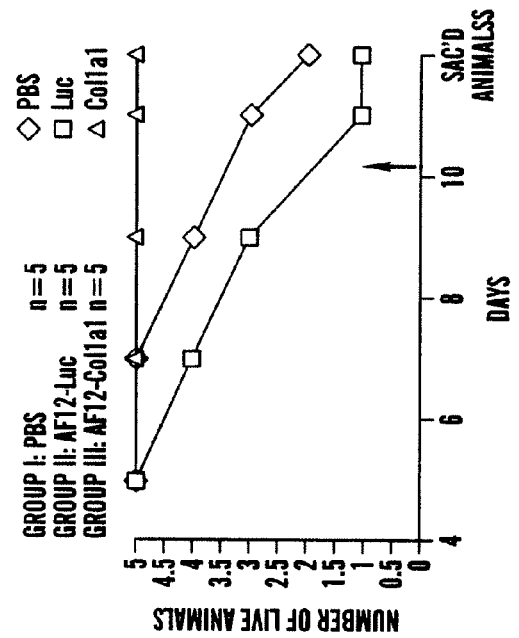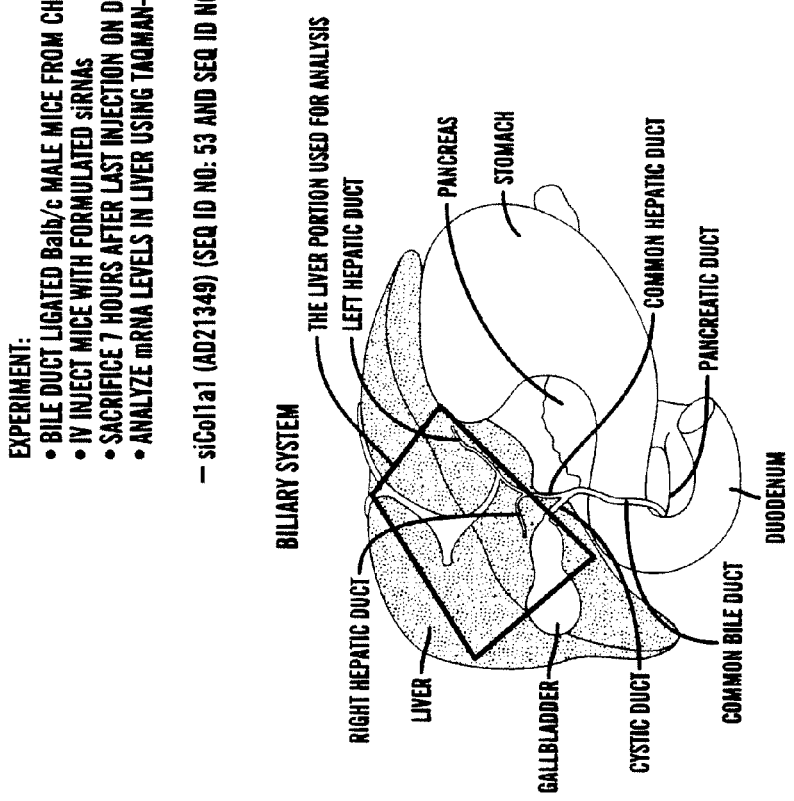
FIG. 16

COMPOSITIONS AND METHODS DIRECTED TO TREATING LIVER FIBROSIS

CROSS REFERENCE TO RELATED APPLICATIONS

This application is a 35 U.S.C. § 371 National Phase Entry Application of International Application No. PCT/US2011/038889 filed 2 Jun. 2011, which designates the U.S., and which claims benefit under 35 U.S.C. § 119(e) of U.S. Provisional Application Ser. No. 61/408,271 filed on Oct. 29, 2010, U.S. Provisional Application Ser. No. 61/371,481 filed on Aug. 6, 2010, and U.S. Provisional Application Ser. No. 61/350,829 filed on Jun. 2, 2010, the contents of each of which are herein incorporated by reference in their entireties.

SEQUENCE LISTING

The instant application contains a Sequence Listing which has been submitted in ASCII format via EFS-Web and is hereby incorporated by reference in its entirety. Said ASCII copy, created on Jun. 2, 2011, is named 51058PCT.txt and is 864,110 bytes in size.

FIELD OF THE INVENTION

The invention relates to the specific inhibition of the expression of the collagen 1A1 (COL1A1), transforming growth factor beta 1 (TGFβ) and SMAD homolog 2 and 3 (SMAD2/3) genes in the liver, and the inhibition of hepatic fibrosis. In particular, the inhibition is directed at the genes expression in hepatic stellate cells.

BACKGROUND OF THE INVENTION

In the United States, chronic liver disease is the 12th leading cause of disease-related death, with approximately 28,000 people dying each year from chronic liver disease. In the US and Europe, liver cirrhosis is the most common cause of non-neoplastic death among hepatobilliary and digestive diseases. Furthermore, the fourth leading cause of death in urban American males is alcoholic liver disease. Chronic liver disease is characterized by a process of progressive destruction and regeneration of liver cells that leads to hepatic fibrosis and cirrhosis.

Hepatic fibrosis is a process that occurs when the liver is damaged. Such damage can be the result of viral activity (e.g., chronic hepatitis types B or C) or other liver infections (e.g., parasites, bacteria); exposure to chemicals (e.g., pharmaceuticals, recreational drugs, excessive alcohol, exposure to pollutants); autoimmune processes (e.g., autoimmune hepatitis); metabolic disorders (e.g., lipid, glycogen, cholesterol or metal storage disorders); or cancer growth (primary or secondary liver cancer). The principal cell type responsible for liver fibrosis is the hepatic stellate cell (HSC), a resident perisinusoidal cell that takes up vitamin A from circulation and stores it.

In the liver, fibrosis is not only the result of necrosis, collapse and scar formation but also the result of derangements in the synthesis and degradation of matrix by injured mesenchymal cells that synthesize the various components of the extracellular matrix (ECM). Hepatic fibrosis is a gradual process of increased secretion and decreased degradation of extracellular materials. It is believed that the process is initiated by damage to hepatic cells. Necrotic hepatic cells present after injury evoke a reaction of inflammatory cells which secrete mediators including cytokines that stimulate matrix producing cells. More particularly, the damage to hepatic cells leads to the activation and secretion of multiple cellular factors from Kupffer cells, the macrophages which line the liver sinusoids. These factors, along with the cellular factors secreted by damaged hepatic cells, thrombocytes, and endothelial cells of the hepatic sinusoid become activators of HSCs. Upon activation, the HSCs differentiate to proliferative, fibrogenic and contractile myofibroblasts, and, via self-secretion and parasecretion, the HSCs proliferate and synthesize a massive amount of ECM materials, which gradually accumulate and form fibrous masses in the liver. The myofibroblasts secrete procollagen, which accumulates as insoluble collagen after its terminal domains are cleaved by procollagen peptides, causing fibrosis. The collagen-specific chaperone, heat shock protein 47 (HSP47), facilitates collagen secretion by ensuring proper triple-helix formation of procollagen in the endoplasmic reticulum and has also been implicated in translational regulation of procollagen synthesis.

The ECM materials are of the following categories: collagens (type I, III, IV, V, VI, VII), glycoprotein (laminin, fibronectin, entactin, undulin, and elastin) and proteoglycans (chondroitin sulphate, dermatan sulphate, keratan sulphate, heparan sulphate and heparin). These ECM materials interact with cell surface receptors and macromolecules such as growth factors, collagens, fibronectin, laminin etc. Fibrosis develops after repeated and persistent injury that overcomes the ability of the liver to degrade the ECM matrix via degrading enzymes produced by fibroblasts, neutrophils and macrophages. The excessive ECM materials built up in the liver lead to derangement of the hepatic architecture and portal hypertension, and can produce the irreversible and detrimental rearrangement of the liver circulation known as cirrhosis. Cirrhosis is characterized by replacement of liver tissue by fibrous, scar tissue and regenerative nodules. These regenerative nodules are the result of a process in which damaged tissue tries to regenerate and this leads to the loss of liver function. Therefore, fibrosis is both a sign of liver damage and a major contributor to liver failure via progressive cirrhosis of the liver. Since fibrosis is a common development in a variety of chronic liver diseases, treatment and/or prevention of liver fibrosis is of great importance.

SUMMARY OF THE INVENTION

Described herein are compositions and methods that effect the RNA-induced silencing complex (RISC)-mediated cleavage of RNA transcripts of a collagen 1A1 (COL1A1), transforming growth factor beta 1 (TGFβ) and/or SMAD homolog 2 and 3 (SMAD2/3) genes, in a cell or mammal. Also described are compositions and methods for treating and/or preventing liver fibrosis caused by the overexpression of a COL1A1 gene that occurs as a result of damage to liver cells, including, but not limited to, chronic liver disease. Liver fibrosis is a result of a viral or other infection, an autoimmune disorder, a bile duct obstruction, metabolic disorders, alcohol abuse, primary biliary cirrhosis, non-alcoholic steatohepatitis (NASH), exposure to chemicals, and cancer among others.

The embodiments of compositions and methods for treating and/or preventing chronic liver disease and hepatic fibrosis are based, at least in part, on the premise that if at least one of the extracellular matrix (ECM) materials that are produced in excess and are contributory to fibrosis during liver damage, including damage occurring under chronic liver injury conditions, can be reduced, then fibrosis in the liver can be, at a minimum, reduced if not prevented. The compositions and methods are based on RNA interference of gene expression of relevant ECM genes and also of the signaling molecules, e.g., TGF-β and SMAD2/3, which are involved in the activation of hepatic stellate cells (HSCs), which are the major producers of ECM materials during the fibrosis process.

As used herein, the term "iRNA" refers to an agent that contains RNA as that term is defined herein, and which mediates the targeted cleavage of an RNA transcript via an RNA-induced silencing complex (RISC) pathway. In one embodiment, an iRNA as described herein inhibits COL1A1, TGFβ or SMAD2/3 gene expression in a cell or mammal.

The iRNAs included in the compositions featured herein encompass a dsRNA having an RNA strand (the antisense strand) having a region that is 30 nucleotides or less, generally 19-24 nucleotides in length, that is substantially complementary to at least part of an mRNA transcript of a COL1A1, TGFβ or SMAD2/3 gene.

In one embodiment, an iRNA for inhibiting expression of a COL1A1, TGFβ or SMAD2/3 gene includes at least two sequences that are complementary to each other. The iRNA includes a sense strand having a first sequence and an antisense strand having a second sequence. The antisense strand includes a nucleotide sequence that is substantially complementary to at least part of an mRNA encoding COL1A1, TGFβ or SMAD2/3 and the region of complementarity is 30 nucleotides or less, and at least 15 nucleotides in length. Generally, the iRNA is 19 to 24, e.g., 19 to 21 nucleotides in length. In some embodiments the iRNA is from about 15 to about 25 nucleotides in length, and in other embodiments the iRNA is from about 25 to about 30 nucleotides in length. The iRNA, upon contacting with a cell expressing COL1A1, TGFβ and/or SMAD2/3, inhibits the expression of a COL1A1, TGFβ or SMAD2/3 gene respectively by at least 10%, at least 20%, at least 25%, at least 30%, at least 35% or at least 40% or more, such as when assayed by a method as described herein. In one embodiment, the COL1A1iRNA, TGFβiRNA or SMAD2/3iRNA is formulated in a stable nucleic acid lipid particle (SNALP).

In one embodiment, an iRNA featured herein includes a first sequence of a dsRNA that is selected from the group consisting of the sense sequences of Tables 3-7 and a second sequence that is selected from the group consisting of the corresponding antisense sequences of Tables 3-7. The iRNA molecules featured herein can include naturally occurring nucleotides or can include at least one modified nucleotide, including, but not limited to a 2'-O-methyl modified nucleotide, a nucleotide having a 5'-phosphorothioate group, and a terminal nucleotide linked to a cholesteryl derivative. Alternatively, the modified nucleotide can be chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide. Generally, such a modified sequence will be based on a first sequence of iRNA selected from the group consisting of the sense sequences of Tables 3-7, and a second sequence selected from the group consisting of the corresponding antisense sequences of Tables 3-7.

In one embodiment, an iRNA as described herein targets a COL1A1 RNA transcript, and in another embodiment, the iRNA targets a TGFβ RNA transcript. In yet another embodiment, the iRNA targets a SMAD2 transcript. In yet another embodiment, the iRNA targets a SMAD3 transcript.

In some embodiments of the aspects described herein, the iRNA is a dsRNA which comprises the RNA sequence pair (AD-21349-b1) of SEQ ID NO: 53 (41100-b1D) and SEQ ID NO: 54 (41101-b1D), the RNA sequence pair (AD-22138) of SEQ ID NO: 69 (42861) and SEQ ID NO: 70 (42862), the RNA sequence pair (AD-22149) of SEQ ID NO: 91 (42883) and SEQ ID NO: 92 (42884) or the RNA sequence pair (AD-20916-b1) of SEQ ID NO: 140 (40322-b1) and SEQ ID NO: 141 (40323-b1).

In one embodiment, an iRNA featured in the invention targets a non-coding region of a COL1A1, TGFβ or SMAD2/3 RNA transcript, such as the 5' or 3' untranslated region.

In one aspect, embodiments of the invention provide a cell containing at least one of the iRNAs featured in the invention. The cell is generally a mammalian cell, such as a human cell. In one preferred embodiment, the cell is a hepatic cell. In a more preferred embodiment, the cell is a HSC.

In another aspect, embodiments of the invention provide a pharmaceutical composition for inhibiting the expression of a COL1A1, TGFβ and/or SMAD2/3 gene in an organism, preferably a human subject. The composition typically includes one or more of the iRNAs described herein and a pharmaceutically acceptable carrier or delivery vehicle. In one embodiment, the composition is used for treating liver disease, including, but not limited to, a chronic liver disease. In one embodiment, the composition is used for treating hepatic fibrosis. In some embodiments, the liver disease or hepatic fibrosis is a result of a viral or other infection, an autoimmune disorder, a bile duct obstruction, metabolic disorders, alcohol abuse, primary biliary cirrhosis, NASH, exposure to chemicals, or cancer.

In another embodiment, the pharmaceutical composition is formulated for administration in a dosage regimen described herein, e.g., not more than once every four weeks, not more than once every three weeks, not more than once every two weeks, or not more than once every week. In another embodiment, the administration of the pharmaceutical composition can be maintained for a month or longer, e.g., one, two, three, or six months, or one year, or five years, or ten years, or longer, including the remaining lifetime of a subject, e.g., for a subject having a chronic liver disease or condition.

In another embodiment, a composition containing an iRNA featured described herein, e.g., a dsRNA targeting COL1A1, is administered with a non-iRNA therapeutic agent, such as an agent known to treat the underlying cause of the liver disease or hepatic fibrosis, e.g. a viral or other infection, an autoimmune disorder, a bile duct obstruction, metabolic disorders, alcohol abuse, primary biliary cirrhosis, NASH, exposure to chemicals, and cancer. In another embodiment, a composition containing an iRNA featured described herein, e.g., a dsRNA targeting COL1A1, is administered along with a non-iRNA therapeutic regimen, such as an anti-hepatitis C virus agent. For example, an iRNA featured in the invention can be administered along with an interferon alpha for treatment of hepatitis C infection.

In another embodiment, a COL1A1 iRNA, TGFβ iRNA and/or SMAD2/3 iRNA is administered to a patient, and then the non-iRNA agent or therapeutic regimen is administered to the patient (or vice versa). In another embodiment, a COL1A1 iRNA, TGFβ iRNA and/or SMAD2/3 iRNA and the non-iRNA therapeutic agent or therapeutic regimen are administered at the same time. In one embodiment, the therapeutic agent is, for example, an interferon alpha for the treatment of hepatitis C infection. In another embodiment, a combination of more than one iRNA is adminstered to the patient. For example, a combination of COL1A1 iRNA and TGFβ iRNA, a combination of COL1A1 iRNA and SMAD2/3 iRNA or a combination of COL1A1 iRNA, TGFβ iRNA and SMAD2/3 iRNA.

In another aspect, provided herein is a method for inhibiting the expression of a COL1A1, a TGFβ, and/or a SMAD2/3 gene in a cell by performing the following steps:
(a) introducing into the cell a double-stranded ribonucleic acid (dsRNA), wherein the dsRNA includes at least two sequences that are complementary to each other. The dsRNA has a sense strand having a first sequence and an antisense strand having a second sequence; the antisense strand has a region of complementarity that is substantially complementary to at least a part of an mRNA encoding COL1A1, TGFβ, and/or a SMAD2/3 and where the region of complementarity is 30 nucleotides or less, i.e., 15-30 nucleotides in length, and generally 19-24 nucleotides in length, and where the dsRNA, upon contact with a cell expressing COL1A1, TGFβ, and/or a SMAD2/3 inhibits expression of a COL1A1, TGFβ, or SMAD2/3 gene respectively by at least 10%, preferably at least 20%, at least 30%, at least 40% or more; and
(b) maintaining the cell produced in step (a) for a time sufficient to obtain degradation of the mRNA transcript of the COL1A1, TGFβ, or SMAD2/3 gene, thereby inhibiting expression of a COL1A1, TGFβ, or SMAD2/3 gene respectively in the cell.

In another embodiment, the method is for inhibiting target gene expression in a liver cell, preferably in a hepatic stellate cell.

In other aspects, provided herein are methods for treating, preventing, reversing or managing liver disease or hepatic fibrosis mediated by, in part, COL1A1 overexpression. In one embodiment, the method includes administering to a patient in need of such treatment, prevention, reversal or management a therapeutically or prophylactically effective amount of one or more of the iRNAs featured herein. In some embodiments, the patient has a chronic liver disease caused by a viral or other infection, an autoimmune disorder, a bile duct obstruction, metabolic disorders, alcohol abuse, primary biliary cirrhosis, NASH, exposure to chemicals, or cancer. In another embodiment, administration of the iRNA targeting COL1A1, TGFβ, or SMAD2/3 alleviates or relieves the severity of at least one symptom of a liver disease or hepatic fibrosis, in the patient, such as high serum albumin and/or jaundice.

In one aspect, the invention provides a vector for inhibiting the expression of a COL1A1, TGFβ, and/or a SMAD2/3 gene in a cell. In one embodiment, the vector includes at least one regulatory sequence operably linked to a nucleotide sequence that encodes at least one strand of an iRNA as described herein.

In another aspect, the invention provides a cell containing a vector for inhibiting the expression of a COL1A1, TGFβ, and/or a SMAD2/3 gene in a cell. The vector includes a regulatory sequence operably linked to a nucleotide sequence that encodes at least one strand of one of the iRNAs as described herein.

In yet another aspect, the invention provides a composition containing a COL1A1 iRNA, in combination with a second iRNA targeting a second gene that is involved in signaling pathway leading to the excess deposition of collagen extracellularly in the liver. For example, the second gene can be the gene encoding TGFβ, SMAD2 or SMAD3.

The details of various embodiments of the invention are set forth in the description below. Other features, objects, and advantages of the invention will be apparent from the description and the drawings, and from the claims.

BRIEF DESCRIPTION OF THE DRAWINGS

FIG. 4 demonstrates a treatment regimen of a $CCl_4$ mouse model in which the dosage response of the AF09 and AF12-based delivery of siCOL1A1 AD21349 (SEQ ID NO: 53 and SEQ ID NO: 54) was evaluated.

FIG. 6 shows a treatment regimen of a $CCl_4$ mouse model in which AF11-based delivery of siCOL1A1 AD21349 (SEQ ID NO: 53 and SEQ ID NO: 54) was evaluated.

FIGS. 15A-15C demonstrate Col1a1 knockdown is mediated by RNAi. FIG. 15A shows a scheme for 5'RACE assay. FIG. 15B shows animals injected with a lipid nanoparticle-siCol1a1 formulation and sacrificed after 24 hours. FIG. 15C shows an agarose gel showing DNA bands for nested PCR.

FIG. 16 demonstrates experimental design and efficacy of COL1A1 knock-down in a bile duct ligation mouse model using AF12-based delivery of siCOL1A1 AD21349 (SEQ ID NO: 53 and SEQ ID NO: 54).

DETAILED DESCRIPTION OF THE INVENTION

Aspects and embodiments described herein relate to compositions and methods for the treatment and/or prevention of liver disease and hepatic fibrosis, including, but not limited to, hepatic fibrosis associated with chronic liver disease. The embodiments exploit the premise that if at least one of the extracellular matrix (ECM) materials that are produced in excess and are contributory to hepatic fibrosis during liver damage can be reduced, then fibrosis of the liver can be, at a minimum, reduced, if not prevented. The compositions and methods described herein are based on RNA interference with gene expression of relevant ECM genes and also those of signaling molecules, e.g. TGF-β and SMAD2/3, that are involved in the activation of hepatic stellate cells (HSCs) during the fibrotic process.

Double-stranded RNA molecules (dsRNA) have been shown to block gene expression in a highly conserved regulatory mechanism known as RNA interference (RNAi). WO 99/32619 (Fire et al.) disclosed the use of a dsRNA of at least 25 nucleotides in length to inhibit the expression of genes in *Caenorhabditis elegans*. dsRNA has also been shown to degrade target RNA in other organisms, including plants (see, e.g., WO 99/53050, Waterhouse et al.; and WO 99/61631, Heifetz et al.), *Drosophila* (see, e.g., Yang, D., et al., Curr. Biol. (2000) 10:1191-1200), and mammals (see WO 00/44895, Limmer; and DE 101 00 586.5, Kreutzer et al.). This natural mechanism has now become the focus for the development of a new class of pharmaceutical agents for treating disorders that are caused by the aberrant or unwanted regulation of a gene.

Figure 2:
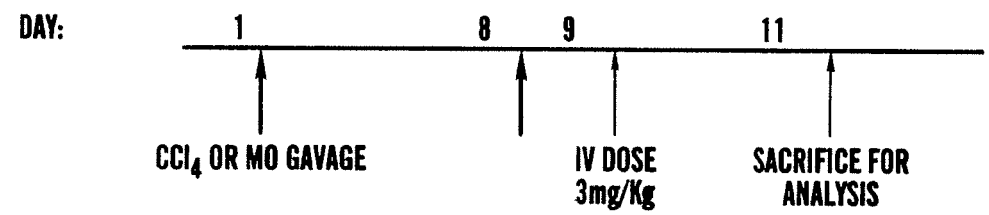
FIG. 2 demonstrates a treatment regimen of a $CCl_4$ mouse model in which the AF09 and AF12-based delivery of siCOL1A1 AD21349 (SEQ ID NO: 53 and SEQ ID NO: 54) was evaluated.
Figure 3:
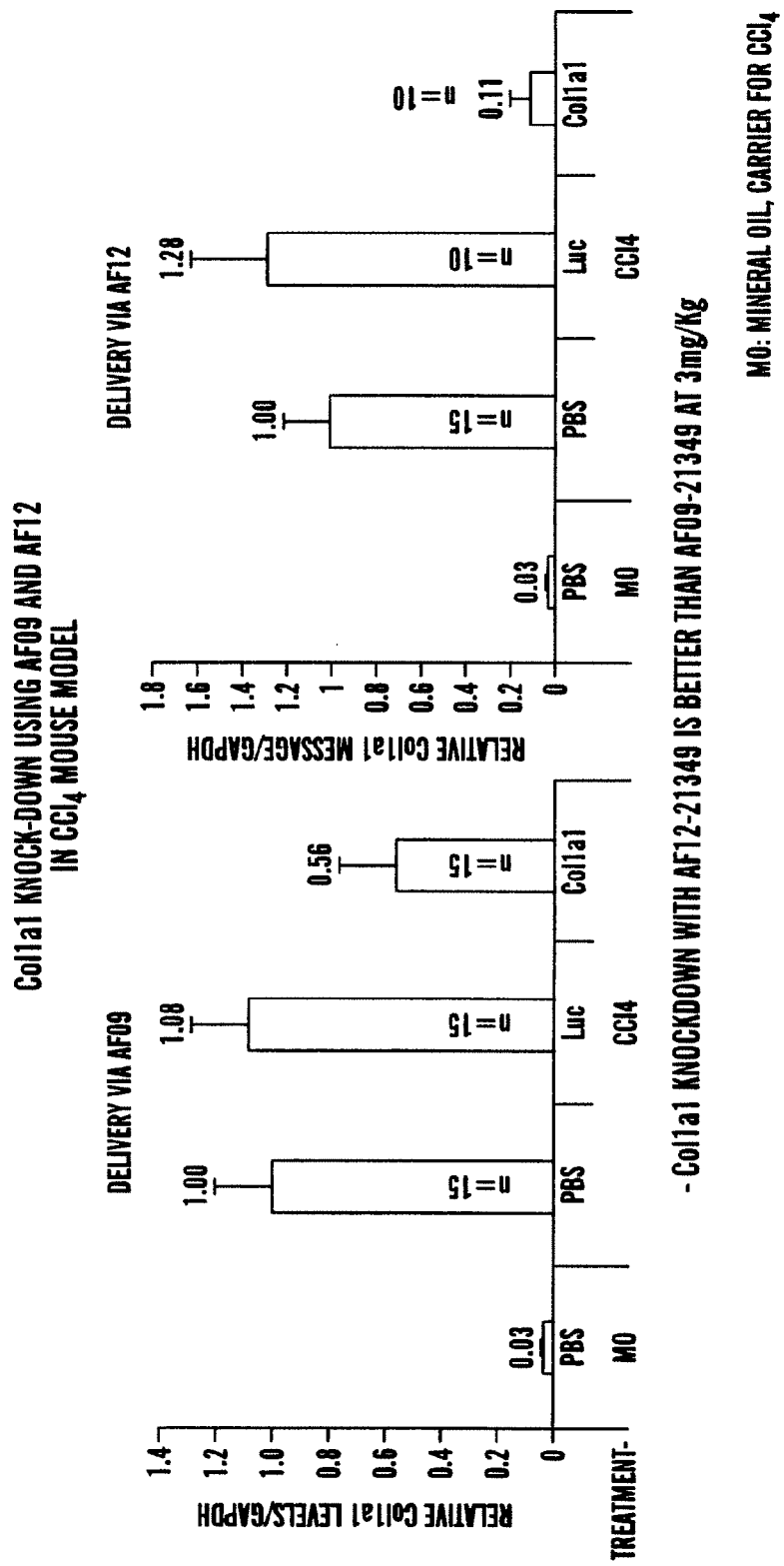
FIG. 3 demonstrates efficacy of COL1A1 knock-down in a $CCl_4$ mouse model using AF09 and AF12-based delivery of siCOL1A1 AD21349 (SEQ ID NO: 53 and SEQ ID NO: 54).
Figure 5:
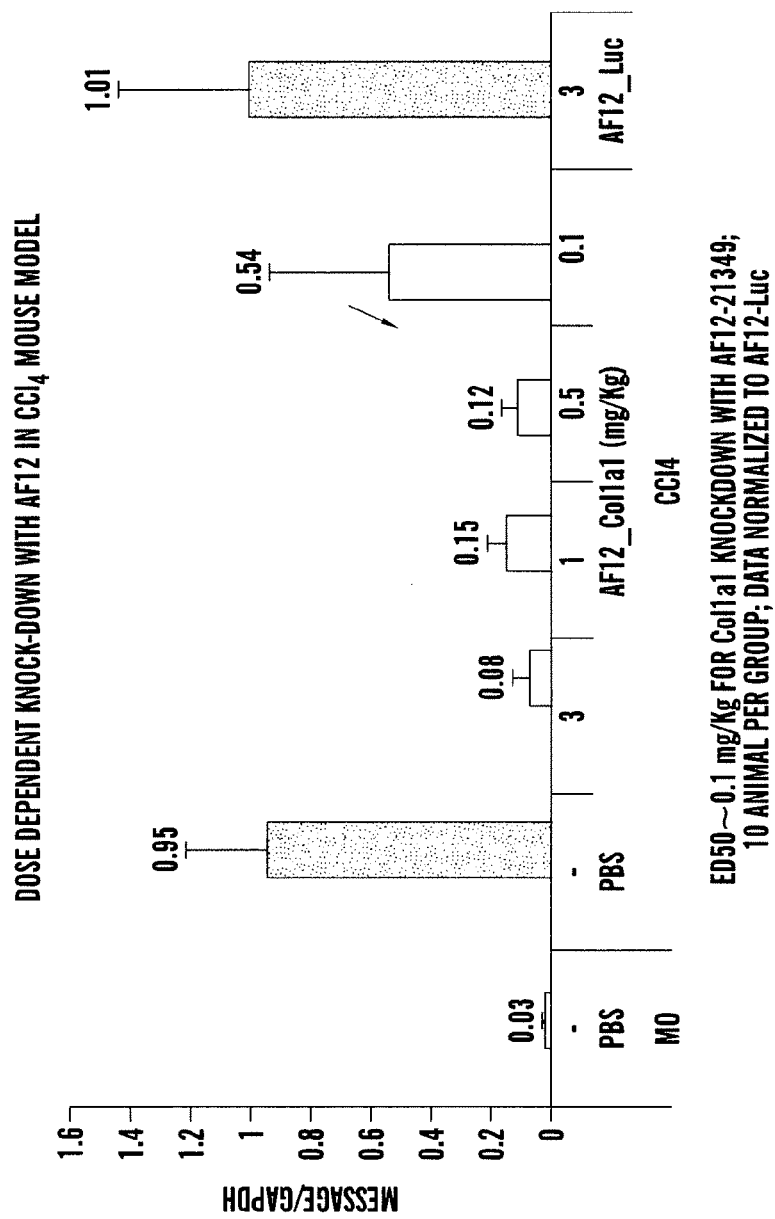
FIG. 5 demonstrates dose dependent efficacy of COL1A1 knock-down in a $CCl_4$ mouse model using the AF12-based delivery of siCOL1A1 AD21349 (SEQ ID NO: 53 and SEQ ID NO: 54).
Figure 13:
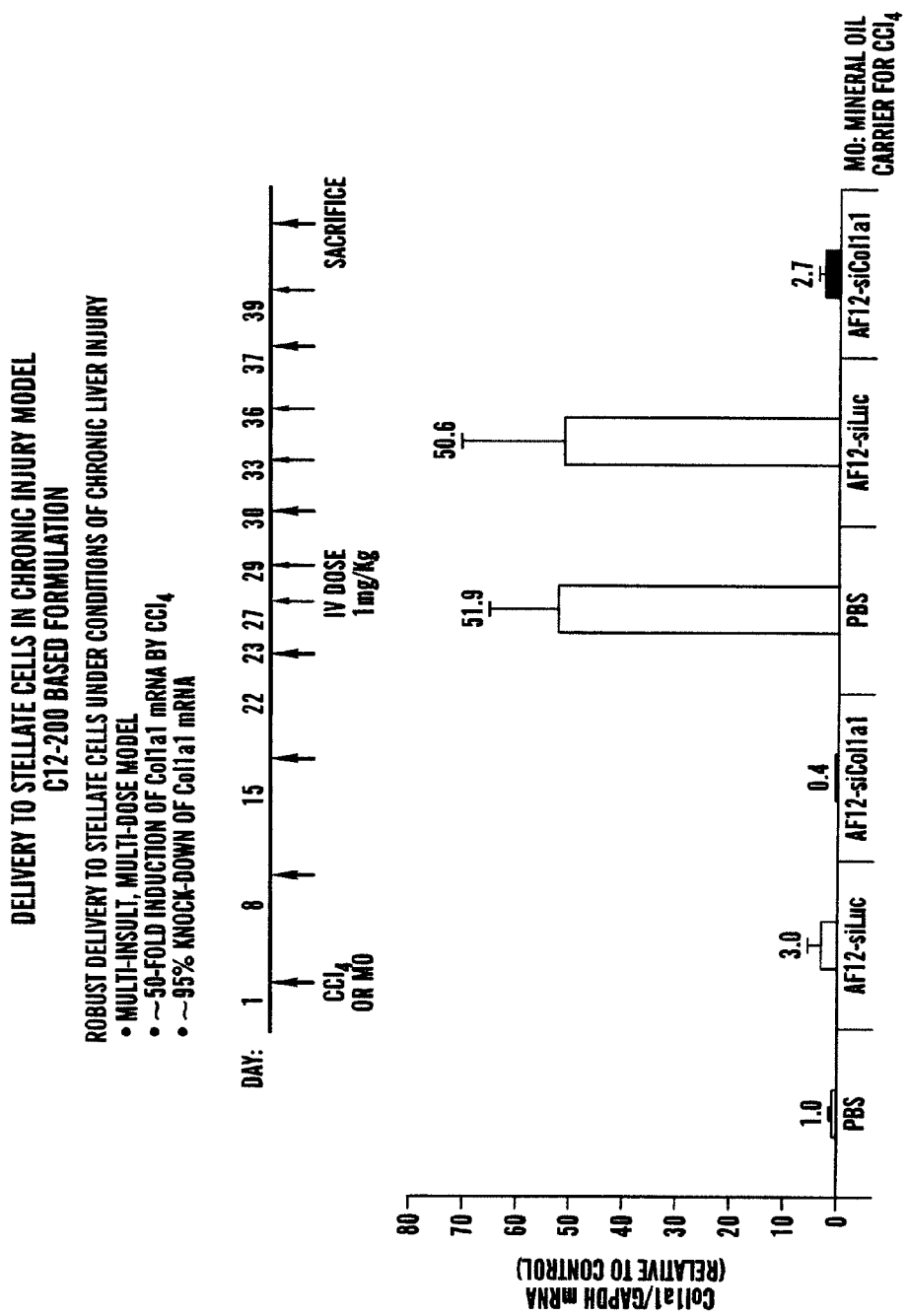
FIG. 13 shows efficacy of COL1A1 knockdown in a chronic liver injury model using a lipid nanoparticle-based formulation of siCOL1A1.
Figure 14:
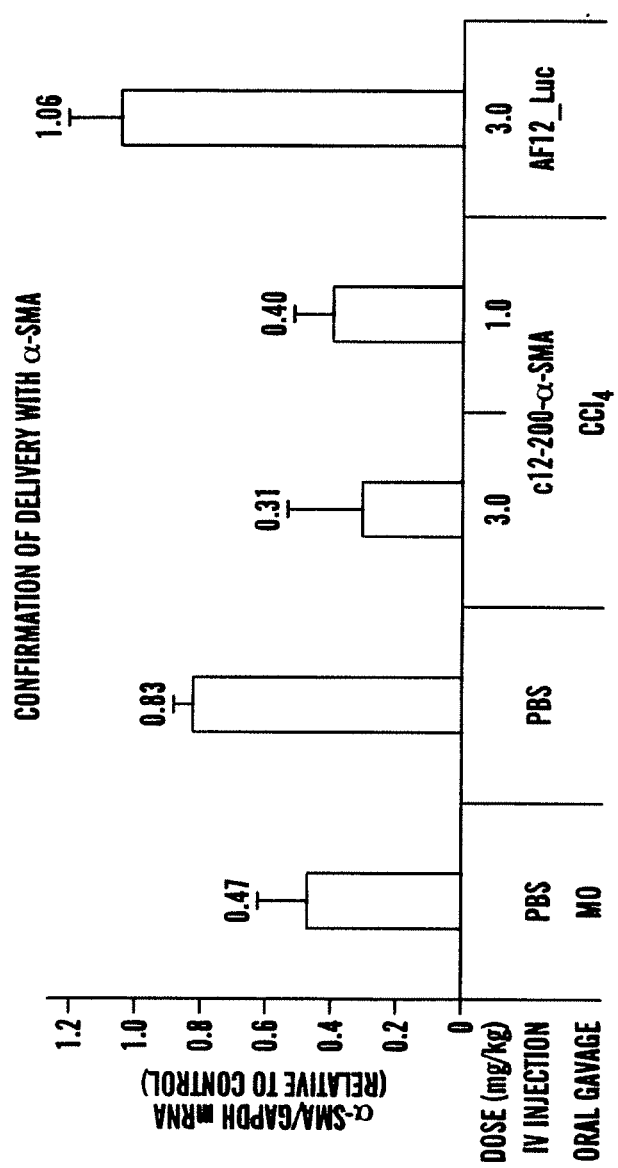
FIG. 14 shows efficacy of delivery to stellate cells with alpha-smooth muscle actin (α-SMA) in a $CCl_4$ mouse model using AF12-based delivery of siACTA2.

One such ECM constituent that contributes to fibrosis in the liver, during chronic liver disease conditions, is collagen 1A1 (COL1A1). As described herein, the inventors show that lipid nanoparticle (LNP) mediated delivery of siRNAs to HSCs in vivo significantly reduced COL1A1 expression in activated HSCs in a carbon tetrachloride (CCl4) induced mouse liver injury model (FIGS. 2-3). Following $CCl_4$ treatment, siRNAs formulated in LNPs comprising the cationic lipid C12-200 (PNAS, 2010, 107 (2):1864) were administered via intravenous injection. Silencing of the expression of the HSC-specific target, COL1A1, demonstrated effective siRNA delivery to HSCs. The COL1A1 knock-down was dose dependent with an $IC_{50}$ of approximately 0.1 mg/kg (FIGS. 4-5). The inventors further surprisingly showed that effective and significant reduction of COL1A1 expression can also be achieved in a mouse model of chronic liver disease, in which mice were subjected to multiple (x6) liver insults over a 39 day period, using the COL1A1 siRNA formulations described herein (FIG. 13).

Figure 9:
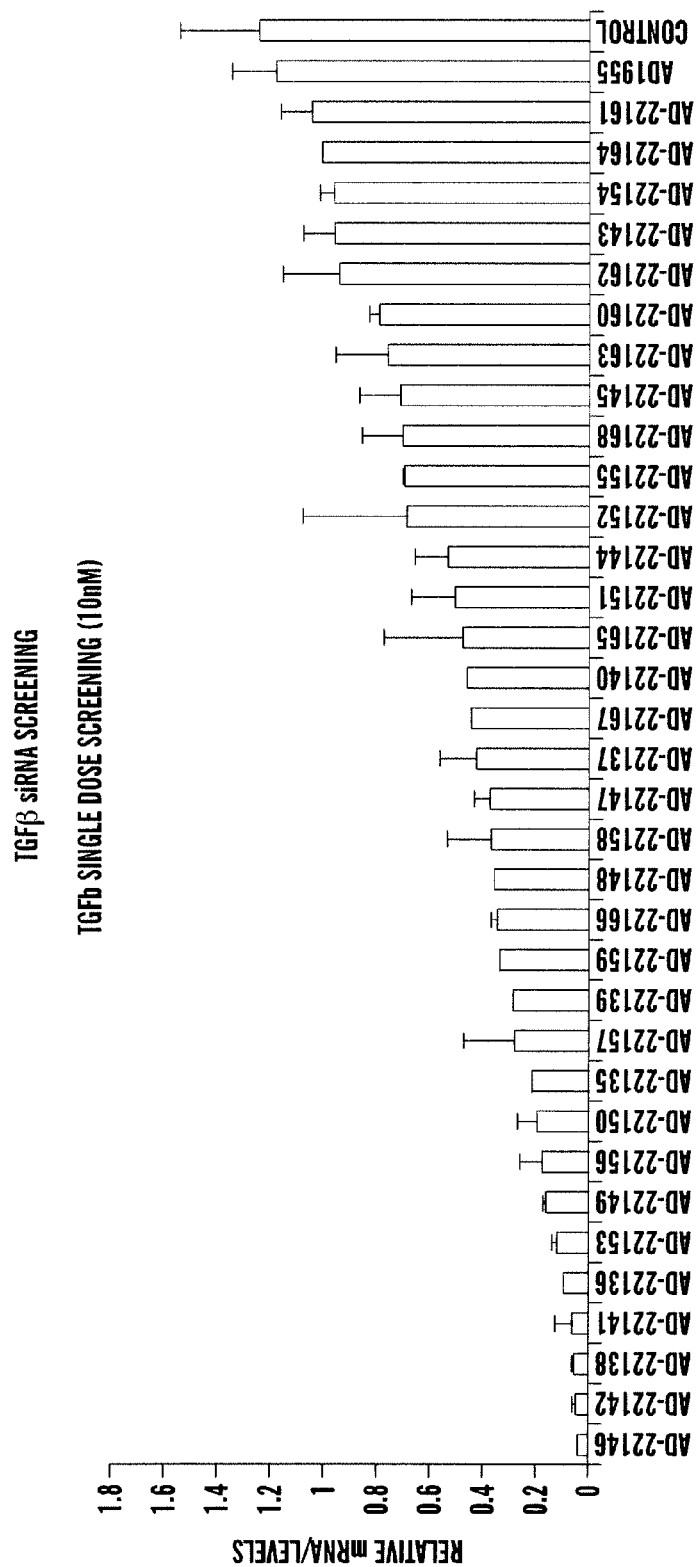
FIG. 9 shows efficacy of a single dose TGFβ siRNA (10 nM) in NIH-3T3 cells in vitro. The TGFβ siRNAs AD22149 (SEQ ID NO: 91 and SEQ ID NO: 92) and AD22138 (SEQ ID NO: 69 and SEQ ID NO: 70) have an $IC_{50}$ of ~20 pM and ~70 pM respectively on TGFβ expression.
Figure 10:
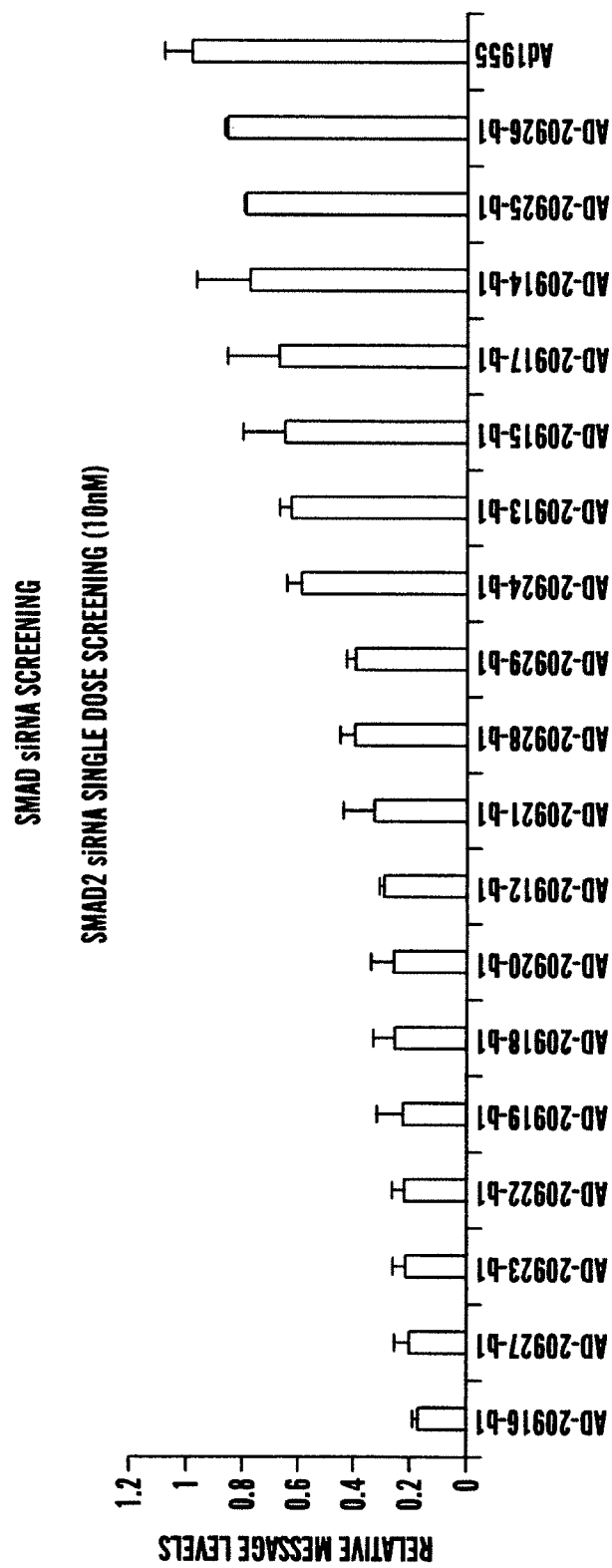
FIG. 10 shows efficacy of a single dose SMAD2 siRNA (10 nM) in NIH-3T3 cells in vitro. The siRNA AD-20916 (SEQ ID NO: 140 and SEQ ID NO: 141) has an $IC_{50}$ of ~75 pM on SMAD2 expression.
Figure 11:
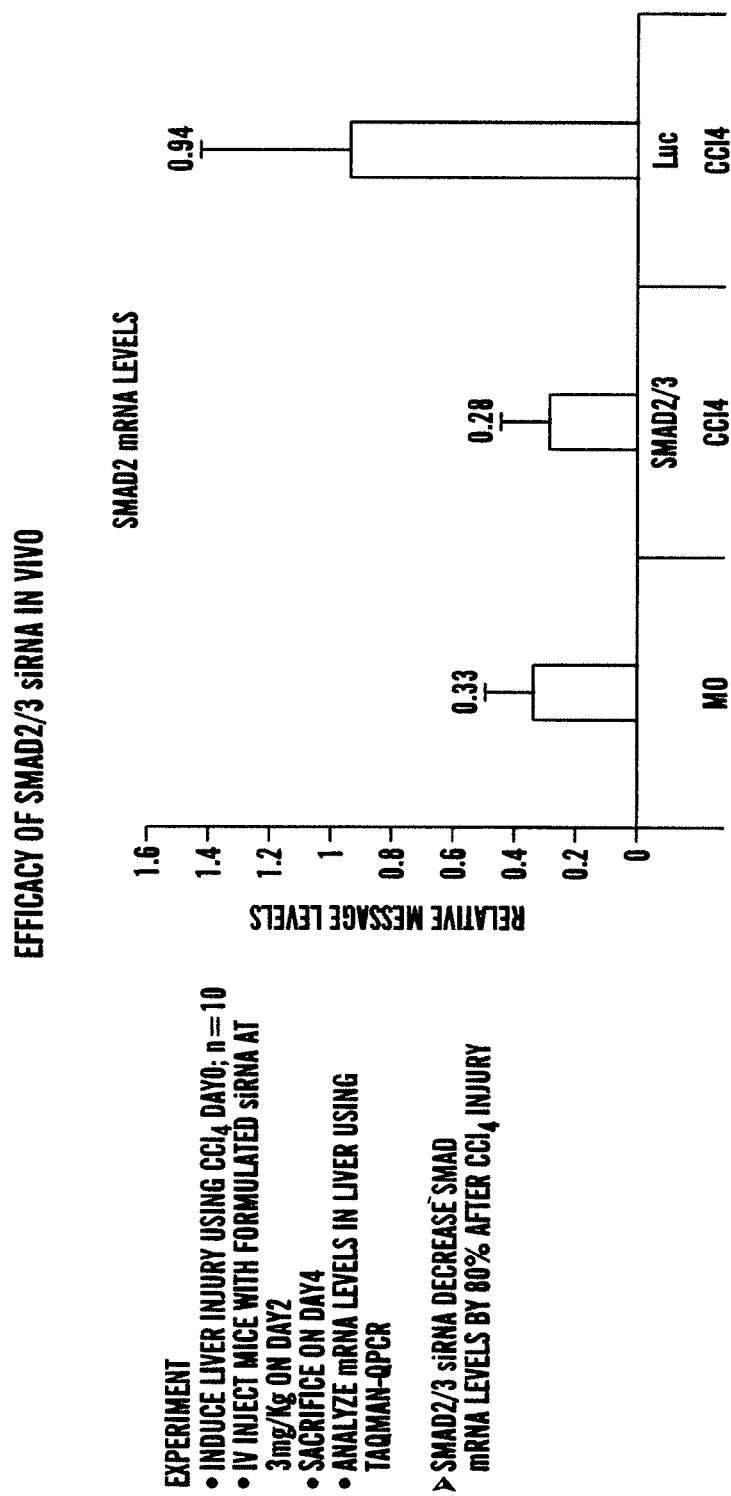
FIG. 11 shows efficacy of SMAD2 knock-down in a $CCl_4$ mouse model using lipid nanoparticle-based delivery of siSMAD2 AD-20916 (SEQ ID NO: 140 and SEQ ID NO: 141).
Figure 12:
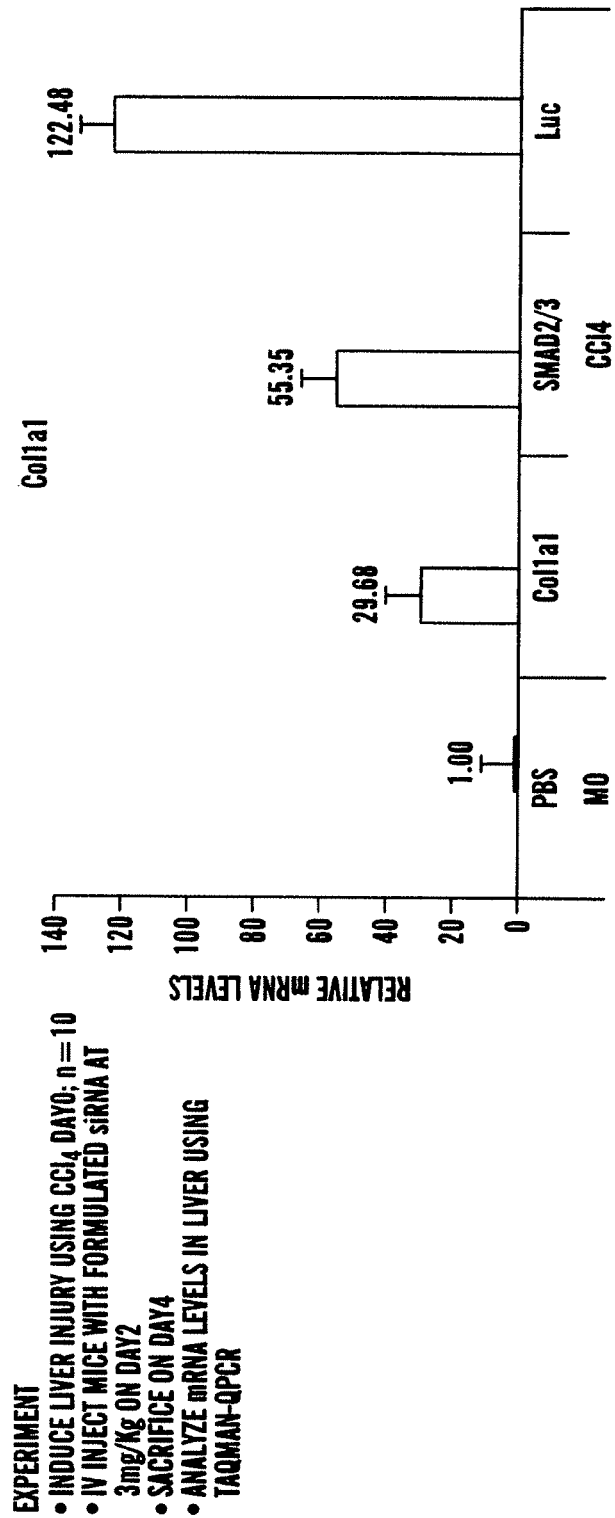
FIG. 12 shows effects of SMAD2 knock-down on the expression of COL1A1 in a $CCl_4$ mouse model using lipid nanoparticle-based delivery of siSMAD2 AD-20916 (SEQ ID NO: 140 and SEQ ID NO: 141). SMAD2/3 siRNA leads to decrease in Col1a1 levels (~50-60% from Luc siRNA injected animals) and the data demonstrates that SMADs are involved in TGFb signaling in fibrosis development

Signaling molecules involved in the activation of HSCs during the fibrotic process include, but are not limited to, TGF-β and SMAD2/3. The inventors demonstrate that LNP-mediated delivery of siRNAs targeting specifically TGF-β and SMAD2/3 significantly reduced the expression of TGF-β and SMAD2/3 in vitro (FIGS. 9-10). The inventors further demonstrate that LNP-mediated delivery of siRNAs targeting specifically SMAD2/3 in the liver significantly reduced the expression of SMAD2/3 and COL1A1 in the $CCl_4$ induced mouse liver injury model (FIGS. 11-12).

Fibrosis is a common pathological feature of many chronic organ failure diseases, including chronic liver disease. Necrotic cells after injury evoke reaction of inflammatory cells which secrete mediators such as cytokines which stimulate matrix producing cells. Essentially, damaged liver cells activate HSCs that secrete materials (e.g., collagens) into the matrix outside the cells. Inappropriate collagen deposition in the ECM is the hallmark of fibrosis and it occurs in the late stage of pathogenesis. Stopping fibrosis can stabilize liver function, delaying time to transplant or providing a survival benefit.

The biology of fibrosis is very well understood. HSC play a central role in the pathogenesis of liver fibrosis, transdifferentiating in chronic liver disease from "quiescent" HSC to fibrogenic myofibroblasts. It is a TGF-β driven process, and SMAD2 and SMAD3 function as TGFβ signaling intermediates. TGF-β, acting both directly and indirectly, is a critical mediator of this process. One approach of treating and/or preventing liver fibrosis is to inhibit HSC proliferation and/or promote HSC apoptosis. Another is to inhibit the HSCs from producing and secreting the ECM components such as collagen to the hepatic ECM that forms the fibrotic mass. COL1A1 is normally present at very low levels in liver but is up-regulated and produced by activated HSCs after insult to the liver. RNAi inhibition of expression of COL1A1, TGFβ, TGFβ-signaling intermediates, such as SMAD2 and SMAD 3, and other proteins/factors that contribute to COL1A1 overexpression can be clinically relevant in treating hepatic fibrosis, regardless of etiology.

Accordingly, aspects and embodiments described herein include iRNAs and methods of using them for inhibiting the expression of a COL1A1, TGFβ and/or SMAD2/3 gene in a cell or a mammal where the iRNA targets a COL1A1, TGFβ and/or SMAD2/3 gene respectively. Also provided herein are compositions and methods for treating and/or preventing liver fibrosis by inhibiting the expression of a COL1A1, TGFβ and/or SMAD2/3 gene. iRNA directs the sequence-specific degradation of mRNA through a process known as RNA interference (RNAi).

In one embodiment of the aspects, provided herein is a double-stranded ribonucleic acid (dsRNA) for inhibiting expression of COL1A1, wherein the dsRNA comprises a sense strand and an antisense strand, wherein the sense strand comprises at least 15 contiguous nucleotides differing by no more than 3 nucleotides from the nucleotide sequence of SEQ ID NO: 53 and the antisense strand comprises at least 15 contiguous nucleotides differing by no more than 3 nucleotides from the corresponding antisense nucleotide sequence of SEQ ID NO: 54.

In another embodiment of the aspects, provided herein is a dsRNA for inhibiting expression of TFGβ, wherein the dsRNA comprises a sense strand and an antisense strand, wherein the sense strand comprises at least 15 contiguous nucleotides differing by no more than 3 nucleotides from the nucleotide sequence of SEQ ID NO: 69 and the antisense strand comprises at least 15 contiguous nucleotides differing by no more than 3 nucleotides from the corresponding antisense nucleotide sequence of SEQ ID NO: 70.

In another embodiment of the aspects, provided herein is a dsRNA for inhibiting expression of TFGβ, wherein the dsRNA comprises a sense strand and an antisense strand, wherein the sense strand comprises at least 15 contiguous nucleotides differing by no more than 3 nucleotides from the nucleotide sequence of SEQ ID NO: 91 and the antisense strand comprises at least 15 contiguous nucleotides differing by no more than 3 nucleotides from the corresponding antisense nucleotide sequence of SEQ ID NO: 92.

In another embodiment of the aspects, provided herein is a dsRNA for inhibiting expression of SMAD2/3, wherein the dsRNA comprises a sense strand and an antisense strand, wherein the sense strand comprises at least 15 contiguous nucleotides differing by no more than 3 nucleotides from the nucleotide sequence of SEQ ID NO: 140 and the antisense strand comprises at least 15 contiguous nucleotides differing by no more than 3 nucleotides from the corresponding antisense nucleotide sequence of SEQ ID NO: 141.

In some embodiments of the aspects described herein, the iRNA is a dsRNA which comprises the RNA sequence pair (AD-21349-b1) of SEQ ID NO: 53 (41100-b1D) and SEQ ID NO: 54 (41101-b1D), the RNA sequence pair (AD-22138) of SEQ ID NO: 69 (42861) and SEQ ID NO: 70 (42862), the RNA sequence pair (AD-22149) of SEQ ID NO: 91 (42883) and SEQ ID NO: 92 (42884) and/or the RNA sequence pair (AD-20916-b1) of SEQ ID NO: 140 (40322-b1) and SEQ ID NO: 141 (40323-b1).

In some embodiments, the sequences for the iRNA comprise sequences identified by the sequence identifiers found in Tables 3-7. Tables 3-7 comprise sequence identifiers (SEQ ID NOs) for sense and corresponding antisense strands. Each row of Table 3 (SEQ ID NO: 1-SEQ ID NO: 62) identifies two separate iRNAs, i.e., two separate pairs of sense strands (odd number sequence identifiers of SEQ ID NO: 1-SEQ ID NO: 62) and corresponding antisense strands (even number sequence identifiers of SEQ ID NO: 1-SEQ ID NO: 62), targeting COL1A1 for use in the compositions and methods described herein. Similarly, each row of Table 4 (SEQ ID NO: 63-SEQ ID NO: 130) identifies two separate iRNAs, i.e., two separate pairs of sense strands (odd number sequence identifiers of SEQ ID NO: 63-SEQ ID NO: 130) and corresponding antisense strands (even number sequence identifiers of SEQ ID NO: 63-SEQ ID NO: 130), targeting TGF-β for use in the compositions and methods described herein. Each row of Table 5 (SEQ ID NO: 132-SEQ ID NO: 167) identifies two separate iRNAs, i.e., two separate pairs of sense strands (even number sequence identifiers of SEQ ID NO: 132-SEQ ID NO: 167) and corresponding antisense strands (odd number sequence identifiers of SEQ ID NO: 132-SEQ ID NO: 167), targeting SMAD2/3 for use in the compositions and methods described herein. Each row of Table 6 (SEQ ID NO: 185-SEQ ID NO: 2792) identifies two separate iRNAs, i.e., two separate pairs of sense strands (odd number sequence identifiers of SEQ ID NO: 185-SEQ ID NO: 2792) and corresponding antisense strands (even number sequence identifiers of SEQ ID NO: 185-SEQ ID NO: 2792) targeting COL1A1 for use in the compositions and methods described herein. Each row of Table 7 (SEQ ID NO: 2793-SEQ ID NO: 2860) identifies two separate iRNAs, i.e., two separate pairs of sense strands (even number sequence identifiers of SEQ ID NO: 2793-SEQ ID NO: 2860) and corresponding antisense strands (odd number sequence identifiers of SEQ ID NO: 2793-SEQ ID NO: 2860) targeting SMAD2/3 for use in the compositions and methods described herein. Accordingly, in some embodiments, the iRNA is a dsRNA which comprises an RNA sequence pair ("sense and corresponding antisense duplex") or "sense strand and corresponding antisense strand" as identified by sequence identifiers (SEQ ID NO) listed in Tables 3-7 and provided herein.

The iRNAs of the compositions featured herein comprise an RNA strand (the antisense strand) having a region which is 30 nucleotides or less in length, i.e., 15-30 nucleotides in length, generally 19-24 nucleotides in length, which region is substantially complementary to at least part of an mRNA transcript of a COL1A1, TGFβ and/or SMAD2/3 gene. The use of these iRNAs enables the targeted degradation of mRNAs of genes that are implicated in the fibrotic process associated with COL1A1 expression or overexpression in the liver. Very low dosages of COL1A1, TGFβ and/or SMAD2/3 iRNAs in particular can specifically and efficiently mediate RNAi, resulting in significant inhibition of expression of a COL1A1, TGFβ and/or SMAD2/3 gene respectively. Using cell-based assays and in vivo model systems, the present inventors have demonstrated that iRNAs targeting COL1A1, TGFβ and/or SMAD2/3 can specifically and efficiently mediate RNAi, resulting in significant inhibition of expression of a respective gene. The inventors have also surprisingly discovered that iRNAs targeting COL1A1 can be used to mediate significant reduction of COL1A1 expression under conditions of repeated or chronic liver injury. Also the inventors demonstrate that SMAD2/3 RNAi mediated inhibition of SMAD2/3 expression indirectly led to the inhibition of COL1A1 expression. Thus, methods and compositions including these iRNAs are useful for treating and/or preventing liver disease and/or liver fibrosis by directly or indirectly down regulating COL1A1 production. The following detailed description discloses how to make and use compositions containing iRNAs to inhibit the expression of a COL1A1, TGFβ and/or SMAD2/3 gene, as well as compositions and methods for treating and/or preventing, and possibly reversing, liver disease characterized by liver fibrosis caused by the expression or overexpression of COL1A1.

Embodiments of compositions featured herein also include an iRNA having an antisense strand having a region of complementarity which is 30 nucleotides or less in length, generally 19-24 nucleotides in length, and is substantially complementary to at least part of an RNA transcript of a COL1A1, TGFβ or SMAD2/3 gene.

Embodiments of the pharmaceutical compositions featured herein include an iRNA having an antisense strand comprising a region which is 30 nucleotides or less in length, generally 19-24 nucleotides in length, which region is substantially complementary to at least part of an RNA transcript of a COL1A1, TGFβ and/or SMAD2/3 gene, together with a pharmaceutically acceptable carrier.

Accordingly, in some aspects, pharmaceutical compositions containing a COL1A1 iRNA, a TGFβ iRNA and/or a SMAD2/3 iRNA and a pharmaceutically acceptable carrier, methods of using the compositions to inhibit expression of a COL1A1, a TGFβ, a SMAD2 and/or a SMAD3 gene, and methods of using the pharmaceutical compositions to treat and/or prevent possibly reverse liver fibrosis caused by the overexpression of a COL1A1 gene are featured in the invention.

In one embodiment, the pharmaceutical composition comprises more than one iRNA type, i.e. iRNAs targeting more than one gene target. For example, the pharmaceutical composition comprises a combination of COL1A1 iRNA and TGFβ iRNA, a combination of COL1A1 iRNA and SMAD2/3 iRNA or a combination of COL1A1 iRNA, TGFβ iRNA and SMAD2/3 iRNA.

In one embodiment, the iRNA is delivered using a vitamin-A-coupled liposome. The HSCs in the liver take up vitamin A from circulation and store it. The Vitamin-A-coupled liposomes function to specifically target the iRNA to the Vitamin A-sequestering HSC.

In one embodiment, the lipid nanoparticle (LNP)-formulation for delivery of iRNA described herein are coupled to vitamin A in order to target the LNP-encapsulated iRNA to the vitamin A-sequestering HSC.

In some embodiments, the pharmaceutical compositions and/or treatment therapies described herein further comprise an additional iRNA targeting a collagen-specific chaperone, heat shock protein 47 (HNP47). Sato, Y. et al., (2008, Nature Biotechnology, 26:431-442) showed that inhibiting expression of HSP47 with an siRNA-bearing vitamin A-coupled liposome almost completely resolved liver fibrosis and prolonged survival in rat treated with lethal dimethylnitrosamine.

I. Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

As used herein, the terms "chronic liver disease" or "chronic liver condition" refer to those diseases in which the liver is subjected to repeated insults and/or injuries over a long-term period, resulting in a process of progressive destruction and regeneration of the liver parenchyma leading to fibrosis and cirrhosis. Chronic liver disease can occur as a consequence of, or is associated with, any of a variety of etiologies, including, but not limited to, viral causes (e.g., Hepatitis B, Hepatitis C, Cytomegalovirus (CMV), Epstein Barr Virus (EBV)); repeated use of toxic substances and/or drugs (e.g., alcoholic liver disease, amiodarone, methotrexate, nitrofurantoin); metabolic/genetic causes/conditions (e.g., non-alcoholic fatty liver disease, haemochromatosis, Wilson's disease); and autoimmune disorders (e.g., autoimmune chronic hepatitis; primary biliary cirrhosis; primary sclerosing cholangitis). A liver disease or condition is considered to be 'chronic,' as used herein, when the condition lasts or continues for at least one month, though, in some preferred embodiments, 'chronic' can be defined as a period of 12 weeks or greater (e.g., such as the remaining lifetime of a subject).

As used herein, the term "fibrosis" refers to the formation of fibrous tissue as a reparative or reactive process, rather than as a normal constituent of an organ or tissue. Fibrosis is characterized by fibroblast accumulation and collagen deposition in excess of normal deposition in any particular tissue. Fibrosis occurs as the result of inflammation, irritation, or healing. As used herein the term "fibrosis" is used synonymously with "fibroblast accumulation and collagen deposition". Fibroblasts are connective tissue cells, which are dispersed in connective tissue throughout the body. Fibroblasts secrete a nonrigid ECM containing type I and/or type III collagen. In response to an injury to a tissue, nearby fibroblasts migrate into the wound, proliferate, and produce large amounts of collagenous extracellular matrix. Collagen is a fibrous protein rich in glycine and proline that is a major component of the extracellular matrix and connective tissue, cartilage, and bone. Collagen molecules are triple-stranded helical structures called α-chains, which are wound around each other in a ropelike helix. Collagen exists in several forms or types; of these, type I, the most common, is found in skin, tendon, and bone; and type III is found in skin, blood vessels, and internal organs.

As used herein, the term "fibrotic process" refers to the temporal and progressive deposition of fibrous tissue during fibrosis.

As used herein, the terms "hepatic fibrosis" refers to the fibrosis present and/or occurring in the liver. The term "hepatic fibrosis" and "liver fibrosis" are used interchangeably.

As used herein, the term "cirrhosis" refers to a late stage of hepatic fibrosis where the liver experiences loss of functional liver cells. Normal liver tissue is replaced with fibrous tissue resulting in widespread distortion of normal hepatic architecture. A major characteristic is regenerative nodules surrounded by dense fibrotic tissue. The overgrowth of fibrosis scar tissue inhibits the liver's proper functioning. Cirrhosis is usually considered irreversible.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety. The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured herein by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods described herein.

As used herein, the term "iRNA" refers to an agent that contains RNA as that term is defined herein, and which mediates the targeted cleavage of an RNA transcript via an RNA-induced silencing complex (RISC) pathway. In one embodiment, an iRNA as described herein inhibits the expression of COL1A1, TGFβ, or SMAD2/3 gene in a cell.

As used herein, "target sequence" refers to a contiguous portion of the nucleotide sequence of an mRNA molecule formed during the transcription of a COL1A1, a TGFβ, a SMAD2 or a SMAD3 gene, including messenger (mRNA) that is a product of RNA processing of a primary transcription product. The target portion of the sequence will be at least long enough to serve as a substrate for iRNA-directed cleavage at or near that portion. For example, the target sequence will generally be from 9-36 nucleotides in length, e.g., 15-30 nucleotides in length, including all sub-ranges therebetween. As non-limiting examples, the target sequence can be from 15-30 nucleotides, 15-26 nucleotides, 15-23 nucleotides, 15-22 nucleotides, 15-21 nucleotides, 15-20 nucleotides, 15-19 nucleotides, 15-18 nucleotides, 15-17 nucleotides, 18-30 nucleotides, 18-26 nucleotides, 18-23 nucleotides, 18-22 nucleotides, 18-21 nucleotides, 18-20 nucleotides, 19-30 nucleotides, 19-26 nucleotides, 19-23 nucleotides, 19-22 nucleotides, 19-21 nucleotides, 19-20 nucleotides, 20-30 nucleotides, 20-26 nucleotides, 20-25 nucleotides, 20-24 nucleotides, 20-23 nucleotides, 20-22 nucleotides, 20-21 nucleotides, 21-30 nucleotides, 21-26 nucleotides, 21-25 nucleotides, 21-24 nucleotides, 21-23 nucleotides, or 21-22 nucleotides.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing. Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs (bp), while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" an mRNA refers to a polynucleotide that is substantially complementary to a contiguous portion of the mRNA of interest (e.g., an mRNA encoding COL1A1). For example, a polynucleotide is complementary to at least a part of a COL1A1mRNA if the sequence is substantially complementary to a non-interrupted portion of an mRNA encoding COL1A1.

The term "double-stranded RNA" or "dsRNA," as used herein refers to an iRNA that includes an RNA molecule or complex of molecules having a hybridized duplex region that comprises two anti-parallel and substantially complementary nucleic acid strands, which will be referred to as having "sense" and "antisense" orientations with respect to a target RNA. The duplex region can be of any length that permits specific degradation of a desired target RNA through a RISC pathway, but will typically range from 9 to 36 base pairs (bp) in length, e.g., 15-30 bp in length. Considering a duplex between 9 and 36 bp the duplex can be any length in this range, for example, 9, 10, 11, 12, 13, 14, 15, 16, 17, 18, 19, 20, 21, 22, 23, 24, 25, 26, 27, 28, 29, 30, 31, 32, 33, 34, 35, or 36 and any sub-range therein between, including, but not limited to 15-30 bp, 15-26 bp, 15-23 bp, 15-22 bp, 15-21 bp, 15-20 bp, 15-19 bp, 15-18 bp, 15-17 bp, 18-30 bp, 18-26 bp, 18-23 bp, 18-22 bp, 18-21 bp, 18-20 bp, 19-30 bp, 19-26 bp, 19-23 bp, 19-22 bp, 19-21 bp, 19-20 bp, 20-30 bp, 20-26 bp, 20-25 bp, 20-24 bp, 20-23 bp, 20-22 bp, 20-21 bp, 21-30 bp, 21-26 bp, 21-25 bp, 21-24 bp, 21-23 bp, or 21-22 bp. dsRNAs generated in the cell by processing with Dicer and similar enzymes are generally in the range of 19-22 bp in length. One strand of the duplex region of a dsDNA comprises a sequence that is substantially complementary to a region of a target RNA. The two strands forming the duplex structure can be from a single RNA molecule having at least one self-complementary region, or can be formed from two or more separate RNA molecules. Where the duplex region is formed from two strands of a single molecule, the molecule can have a duplex region separated by a single stranded chain of nucleotides (herein referred to as a "hairpin loop") between the 3'-end of one strand and the 5'-end of the respective other strand forming the duplex structure. The hairpin loop can comprise at least one unpaired nucleotide; in some embodiments the hairpin loop can comprise at least 3, at least 4, at least 5, at least 6, at least 7, at least 8, at least 9, at least 10, at least 20, at least 23 or more unpaired nucleotides. Where the two substantially complementary strands of a dsRNA are comprised by separate RNA molecules, those molecules need not, but can be covalently connected. Where the two strands are connected covalently by means other than a hairpin loop, the connecting structure is referred to as a "linker." The term "siRNA" is also used herein to refer to a dsRNA as described above.

The skilled artisan will recognize that the term "RNA molecule" or "ribonucleic acid molecule" encompasses not only RNA molecules as expressed or found in nature, but also analogs and derivatives of RNA comprising one or more ribonucleotide/ribonucleoside analogs or derivatives as described herein or as known in the art. Strictly speaking, a "ribonucleoside" includes a nucleoside base and a ribose sugar, and a "ribonucleotide" is a ribonucleoside with one, two or three phosphate moieties. However, the terms "ribonucleoside" and "ribonucleotide" can be considered to be equivalent as used herein. The RNA can be modified in the nucleobase structure or in the ribose-phosphate backbone structure, e.g., as described herein below. However, the molecules comprising ribonucleoside analogs or derivatives must retain the ability to form a duplex. As non-limiting examples, an RNA molecule can also include at least one modified ribonucleoside including but not limited to a 2'-O-methyl modified nucleoside, a nucleoside comprising a 5' phosphorothioate group, a terminal nucleoside linked to a cholesteryl derivative or dodecanoic acid bisdecylamide group, a locked nucleoside, an abasic nucleoside, a 2'-deoxy-2'-fluoro modified nucleoside, a 2'-amino-modified nucleoside, 2'-alkyl-modified nucleoside, morpholino nucleoside, a phosphoramidate or a non-natural base comprising nucleoside, or any combination thereof. Alternatively, an RNA molecule can comprise at least two modified ribonucleosides, at least 3, at least 4, at least 5, at least 6, at least 7, at least 8, at least 9, at least 10, at least 15, at least 20 or more, up to the entire length of the dsRNA molecule. The modifications need not be the same for each of such a plurality of modified ribonucleosides in an RNA molecule. In one embodiment, modified RNAs contemplated for use in methods and compositions described herein are peptide nucleic acids (PNAs) that have the ability to form the required duplex structure and that permit or mediate the specific degradation of a target RNA via a RISC pathway.

In one aspect, a modified ribonucleoside includes a deoxyribonucleoside. In such an instance, an iRNA agent can comprise one or more deoxynucleosides, including, for example, a deoxynucleoside overhang(s), or one or more deoxynucleosides within the double stranded portion of a dsRNA. However, it is self evident that under no circumstances is a double stranded DNA molecule encompassed by the term "iRNA."

In one aspect, an RNA interference agent includes a single stranded RNA that interacts with a target RNA sequence to direct the cleavage of the target RNA. Without wishing to be bound by theory, long double stranded RNA introduced into plants and invertebrate cells is broken down into siRNA by a Type III endonuclease known as Dicer (Sharp et al., Genes Dev. 2001, 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleaves the target to induce silencing (Elbashir, et al., (2001) Genes Dev. 15:188). Thus, in one aspect the invention relates to a single stranded RNA that promotes the formation of a RISC complex to effect silencing of the target gene.

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5' end, 3' end or both ends of either an antisense or sense strand of a dsRNA.

In one embodiment, the antisense strand of a dsRNA has a 1-10 nucleotide overhang at the 3' end and/or the 5' end. In one embodiment, the sense strand of a dsRNA has a 1-10 nucleotide overhang at the 3' end and/or the 5' end. In another embodiment, one or more of the nucleotides in the overhang is replaced with a nucleoside thiophosphate.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double-stranded over its entire length.

The term "antisense strand" or "guide strand" refers to the strand of an iRNA, e.g., a dsRNA, which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5' and/or 3' terminus.

The term "sense strand" or "passenger strand" as used herein, refers to the strand of an iRNA that includes a region that is substantially complementary to a region of the antisense strand as that term is defined herein.

As used herein, in one embodiment, the term "SNALP" refers to a stable nucleic acid-lipid particle. A SNALP represents a vesicle of lipids coating a reduced aqueous interior comprising a nucleic acid such as an iRNA or a plasmid from which an iRNA is transcribed. SNALPs are described, e.g., in U.S. Patent Application Publication Nos. 20060240093, 20070135372, and in International Application No. WO2009082817. Examples of "SNALP" formulations are described elsewhere herein.

"Introducing into a cell," when referring to an iRNA, means facilitating or effecting uptake or absorption into the cell, as is understood by those skilled in the art. Absorption or uptake of an iRNA can occur through unaided diffusive or active cellular processes, or by auxiliary agents or devices. The meaning of this term is not limited to cells in vitro; an iRNA can also be "introduced into a cell," wherein the cell is part of a living organism. In such an instance, introduction into the cell will include the delivery to the organism. For example, for in vivo delivery, iRNA can be injected into a tissue site or administered systemically. In vivo delivery can also be by a beta-glucan delivery system, such as those described in U.S. Pat. Nos. 5,032,401 and 5,607,677, and U.S. Publication No. 2005/0281781, which are hereby incorporated by reference in their entirety. In vitro introduction into a cell includes methods known in the art such as electroporation and lipofection. Further approaches are described herein below or are known in the art.

As used herein, the phrase "inhibit the expression of," refers to at an least partial "reduction" of COL1A1, TGFβ or SMAD2/3 gene expression in a cell treated with an iRNA composition as described herein compared to the expression of COL1A1, TGFβ or SMAD2/3 respectively in an untreated cell.

The terms "silence," "inhibit the expression of," "downregulate the expression of," "suppress the expression of," and the like, in so far as they refer to a COL1A1, TGFβ and/or SMAD2/3 gene, herein refer to the at least partial suppression of the expression of the COL1A1, TGFβ and/or SMAD2/3 gene, as manifested by a reduction of the amount of COL1A1, TGFβ and/or SMAD2/3 mRNA respectively which can be isolated from or detected in a first cell or group of cells in which the COL1A1, TGFβ and/or SMAD2/3 gene is transcribed and which has or have been treated such that the expression of the COL1A1, TGFβ and/or SMAD2/3 gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition can be given in terms of a reduction of a parameter that is functionally linked to COL1A1, TGFβ or SMAD2/3 gene expression, e.g., the amount of protein encoded by the COL1A1, TGFβ or SMAD2/3 gene respectively, or the number of cells displaying a certain phenotype, e.g., lack of or decreased cytokine production. In principle, COL1A1, TGFβ and/or SMAD2/3 gene silencing can be determined in any cell expressing COL1A1, TGFβ and/or SMAD2/3 either constitutively or by genomic engineering, and by any appropriate assay. However, when a reference is needed in order to determine whether a given iRNA inhibits the expression of the COL1A1, TGFβ and/or SMAD2/3 gene by a certain degree and therefore is encompassed by the instant invention, the assays provided in the Examples below shall serve as such reference.

For example, in certain instances, expression of the COL1A1, TGFβ and/or SMAD2/3 gene is suppressed by at least about 10%, 15%, 20%, 25%, 30%, 35%, 40%, 45%, or 50% by administration of an iRNA featured herein. In some embodiments, the COL1A1, TGFβ and/or SMAD2/3 gene is suppressed by at least about 60%, 70%, or 80% by administration of an iRNA featured herein. In some embodiments, the COL1A1, TGFβ and/or SMAD2/3 gene is suppressed by at least about 85%, 90%, 95%, 98%, 99%, or more by administration of an iRNA as described herein.

As used herein in the context of COL1A1, TGFβ and/or SMAD2/3 expression, the terms "treat," "treatment," and the like, refer to relief from or alleviation of liver fibrosis mediated by COL1A1 overexpression. In some embodiment, the terms "treat," "treatment," and the like mean to relieve or alleviate at least one symptom associated with liver fibrosis, or to slow or reverse the fibrotic process.

By "lower" in the context of a liver function, or liver fibrosis biomarker or a liver fibrosis symptom is meant a statistically significant decrease in such level. The decrease can be, for example, at least 10%, at least 20%, at least 30%, at least 40% or more, and is preferably down to a level accepted as within the range of normal for an individual without liver failure, a chronic liver disease, liver fibrosis, or cirrhosis.

As used herein, the phrases "therapeutically effective amount" and "prophylactically effective amount" refer to an amount that provides a therapeutic benefit in the treatment, prevention, or management of liver fibrosis, which is mediated by COL1A1 overexpression. The specific amount that is therapeutically effective can be readily determined by an ordinary medical practitioner, and can vary depending on factors known in the art, such as, for example, the patient's history and age, the stage of liver disease or liver fibrosis, and the administration of other agents that indirectly inhibit the COL1A1 overexpression and other agents that treat the underlying causes leading to chronic liver injury and fibrosis.

As used herein, a "pharmaceutical composition" comprises a pharmacologically effective amount of an iRNA and a pharmaceutically acceptable carrier. As used herein, "pharmacologically effective amount," "therapeutically effective amount" or simply "effective amount" refers to that amount of an iRNA effective to produce the intended pharmacological, therapeutic or preventive result. For example, if a given clinical treatment is considered effective when there is at least a 10% reduction in a measurable parameter associated with a disease or disorder, a therapeutically effective amount of a drug for the treatment of that disease or disorder is the amount necessary to effect at least a 10% reduction in that parameter. For example, a therapeutically effective amount of an iRNA targeting a COL1A1 gene can reduce COL1A1 protein levels by at least 10%.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents can include starch and gelatin, while the lubricating agent, if present, will generally be magnesium stearate, stearic acid or talc. If desired, the tablets can be coated with a material such as glyceryl monostearate or glyceryl distearate, to delay absorption in the gastrointestinal tract. Agents included in drug formulations are described further herein below.

As used herein, a therapeutic that "prevents" a fibrosis is a composition that, in a statistical sample, reduces the occurrence of fibrosis in the treated sample relative to an untreated control sample, or delays the onset or reduces the severity of one or more symptoms of the disorder or condition relative to the untreated control sample.

An "infection" as used herein refers to a disease or condition attributable to the presence in a host of a foreign organism or agent that reproduces within the host. Infections typically involve breach of a normal mucosal or other tissue barrier by an infectious organism or agent. A subject that has an infection is a subject having objectively measurable infectious organisms or agents present in the subject's body.

As used herein, a "subject" is a mammal, e.g. a dog, horse, cat, and other non-human primates. In a preferred embodiment, a subject is a human.

As used herein, the term "LNPXX", wherein the "XX" are numerals, is also referred to as "AFXX" herein. For example, LNP09 is also referred to AF09 and LNP12 is also known as or referred to as AF12.

As used herein, the term "comprising" or "comprises" is used in reference to compositions, methods, and respective component(s) thereof, that are essential to the invention, yet open to the inclusion of unspecified elements, whether essential or not.

As used herein, the term "consisting essentially of" refers to those elements required for a given embodiment. The term permits the presence of elements that do not materially affect the basic and novel or functional characteristic(s) of that embodiment of the invention.

The term "consisting of" refers to compositions, methods, and respective components thereof as described herein, which are exclusive of any element not recited in that description of the embodiment.

II. Double-Stranded Ribonucleic Acid (dsRNA)

Described herein are iRNA agents that inhibit the expression of the COL1A1, TGFβ and/or SMAD2/3 genes. In one embodiment, the iRNA agent includes double-stranded ribonucleic acid (dsRNA) molecules for inhibiting the expression of a COL1A1, TGFβ and/or SMAD2/3 gene respectively in a cell or mammal, e.g., in a human having a liver disease characterized by hepatic fibrosis, where the dsRNA includes an antisense strand having a region of complementarity which is complementary to at least a part of an mRNA formed in the expression of a COL1A1, TGFβ or SMAD2/3 gene, and where the region of complementarity is 30 nucleotides or less in length, generally 19-24 nucleotides in length, and where the dsRNA, upon contact with a cell expressing the COL1A1, TGFβ or SMAD2/3 gene respectively, inhibits the expression of the COL1A1, TGFβ and/or SMAD2/3 gene respectively by at least 10% as assayed by, for example, a PCR or branched DNA (bDNA)-based method, or by a protein-based method, such as by Western blot. Expression of a COL1A1 gene in cell culture, such as in COS cells, HeLa cells, primary hepatocytes, HepG2 cells, primary cultured HSCs or in a biological sample from a subject can be assayed by measuring COL1A1 mRNA levels, such as by bDNA or TaqMan assay, or by measuring protein levels, such as by immunofluorescence analysis, using, for example, Western Blotting or flowcytometric techniques.

A dsRNA includes two RNA strands that are complementary to hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a COL1A1, TGFβ or SMAD2/3 gene. The other strand (the sense strand) includes a region that is complementary to the antisense strand, such that the two strands hybridize and form a duplex structure when combined under suitable conditions. Generally, the duplex structure is between 15 and 30 inclusive, more generally between 18 and 25 inclusive, yet more generally between 19 and 24 inclusive, and most generally between 19 and 21 base pairs in length, inclusive. Similarly, the region of complementarity to the target sequence is between 15 and 30 inclusive, more generally between 18 and 25 inclusive, yet more generally between 19 and 24 inclusive, and most generally between 19 and 21 nucleotides in length, inclusive. In some embodiments, the dsRNA is between 15 and 20 nucleotides in length, inclusive, and in other embodiments, the dsRNA is between 25 and 30 nucleotides in length, inclusive. As the ordinarily skilled person will recognize, the targeted region of an RNA targeted for cleavage will most often be part of a larger RNA molecule, often an mRNA molecule. Where relevant, a "part" of an mRNA target is a contiguous sequence of an mRNA target of sufficient length to be a substrate for RNAi-directed cleavage (i.e., cleavage through a RISC pathway). dsRNAs having duplexes as short as 9 bp can, under some circumstances, mediate RNAi-directed RNA cleavage. Most often a target will be at least 15 nucleotides in length, preferably 15-30 nucleotides in length.

One of skill in the art will also recognize that the duplex region is a primary functional portion of a dsRNA, e.g., a duplex region of 9 to 36, e.g., 15-30 bp. Thus, in one embodiment, to the extent that it becomes processed to a functional duplex of e.g., 15-30 bps that targets a desired RNA for cleavage, an RNA molecule or complex of RNA molecules having a duplex region greater than 30 bp is a dsRNA. Thus, an ordinarily skilled artisan will recognize that in one embodiment, then, an miRNA is a dsRNA. In another embodiment, a dsRNA is not a naturally occurring miRNA. In another embodiment, an iRNA agent useful to target COL1A1, TGFβ and/or SMAD2/3 expression is not generated in the target cell by cleavage of a larger dsRNA.

A dsRNA as described herein can further include one or more single-stranded nucleotide overhangs. The dsRNA can be synthesized by standard methods known in the art as further discussed below, e.g., by use of an automated DNA synthesizer, such as are commercially available from, for example, Biosearch, Applied Biosystems, Inc.

In one embodiment, a COL1A1 gene is a human COL1A1 gene. In another embodiment the COL1A1 gene is a mouse or a rat COL1A1 gene. In one embodiment, an iRNA cross react with human and/or mouse and rat COL1A1 sequence. In specific embodiments, the first sequence is a sense strand of a dsRNA that includes a sense sequence from Table 3 and Table 6, and the second sequence is selected from the group consisting of the corresponding antisense sequences of Table 3 and Table 6. Alternative dsRNA agents that target elsewhere in the target sequence provided in Table 3 and Table 6 can readily be determined using the target sequence and the flanking COL1A1 sequence.

In one embodiment, a TGFβ gene is a human TGFβ gene. In another embodiment the TGFβ gene is a mouse or a rat TGFβ gene. In specific embodiments, the first sequence is a sense strand of a dsRNA that includes a sense sequence from Table 4 and Table 7, and the second sequence is selected from the group consisting of the corresponding antisense sequences of Table 4 and Table 7. Alternative dsRNA agents that target elsewhere in the target sequence provided in Table 4 and Table 7 can readily be determined using the target sequence and the flanking TGFβ sequence. In one embodiment, an iRNA cross react with human and/or mouse and rat TGFβ sequence.

In one embodiment, a SMAD2/3 gene is a human SMAD2/3 gene. In another embodiment the SMAD2/3 gene is a mouse or a rat SMAD2/3 gene. In specific embodiments, the first sequence is a sense strand of a dsRNA that includes a sense sequence from Table 5, and the second sequence is selected from the group consisting of the corresponding antisense sequences of Table 5. Alternative dsRNA agents that target elsewhere in the target sequence provided in Table 5 can readily be determined using the target sequence and the flanking SMAD2/3 sequence. In one embodiment, an iRNA cross react with human and/or mouse and rat SMAD2/3 sequence.

In one aspect, a dsRNA will include at least two nucleotide sequences, a sense and an anti-sense sequence, whereby the sense strand is selected from the groups of sequences provided in Tables 3-7, and the corresponding antisense strand of the sense strand selected from Table 3-7. In this aspect, one of the two sequences is complementary to the other of the two sequences, with one of the sequences being substantially complementary to a sequence of an mRNA generated in the expression of a COL1A1, TGFβ and/or SMAD2/3 gene. As such, in this aspect, a dsRNA will include two oligonucleotides, where one oligonucleotide is described as the sense strand in Table 3-7, and the second oligonucleotide is described as the corresponding antisense strand of the sense strand from Tables 3-7. As described elsewhere herein and as known in the art, the complementary sequences of a dsRNA can also be contained as self-complementary regions of a single nucleic acid molecule, as opposed to being on separate oligonucleotides.

The skilled person is well aware that dsRNAs having a duplex structure of between 20 and 23, but specifically 21, base pairs have been hailed as particularly effective in inducing RNA interference (Elbashir et al., EMBO 2001, 20:6877-6888). However, others have found that shorter or longer RNA duplex structures can be effective as well. In the embodiments described above, by virtue of the nature of the oligonucleotide sequences identified by sequence identifiers provided in Tables 3-7, dsRNAs described herein can include at least one strand of a length of minimally 21 nt. It can be reasonably expected that shorter duplexes having one of the sequences of Tables 3-7 minus only a few nucleotides on one or both ends can be similarly effective as compared to the dsRNAs described above. Hence, dsRNAs having a partial sequence of at least 15, 16, 17, 18, 19, 20, or more contiguous nucleotides from one of the sequences of Tables 3-7, and differing in their ability to inhibit the expression of a COL1A1, TGFβ and/or SMAD2/3 gene by not more than 5, 10, 15, 20, 25, or 30% inhibition from a dsRNA comprising the full sequence, are contemplated according to the invention.

In addition, the RNAs provided in Tables 3-7 identify a site in a COL1A1, TGFβ and/or SMAD2/3 transcript that is susceptible to RISC-mediated cleavage. As such, the present invention further features iRNAs that target within one of such sequences. As used herein, an iRNA is said to target within a particular site of an RNA transcript if the iRNA promotes cleavage of the transcript anywhere within that particular site. Such an iRNA will generally include at least 15 contiguous nucleotides from one of the sequences provided in Tables 3-7 coupled to additional nucleotide sequences taken from the region contiguous to the selected sequence in a COL1A1, TGFβ and/or SMAD2/3 gene respectively.

While a target sequence is generally 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified, for example, by sequence identifier in Tables 3-7 represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified by sequence identifier, e.g., in Tables 3-7, further optimization could be achieved by systematically either adding or removing nucleotides to generate longer or shorter sequences and testing those and sequences generated by walking a window of the longer or shorter size up or down the target RNA from that point. Again, coupling this approach to generating new candidate targets with testing for effectiveness of iRNAs based on those target sequences in an inhibition assay as known in the art or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes, etc.) as an expression inhibitor.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch not be located in the center of the region of complementarity. If the antisense strand of the iRNA contains mismatches to the target sequence, it is preferable that the mismatch be restricted to be within the last 5 nucleotides from either the 5' or 3' end of the region of complementarity. For example, for a 23 nucleotide iRNA agent RNA strand which is complementary to a region of a COL1A1, TGFβ and/or SMAD2/3 gene, the RNA strand generally does not contain any mismatch within the central 13 nucleotides. The methods described herein or methods known in the art can be used to determine whether an iRNA containing a mismatch to a target sequence is effective in inhibiting the expression of a COL1A1, TGFβ and/or SMAD2/3 gene respectively. Consideration of the efficacy of iRNAs with mismatches in inhibiting expression of a COL1A1, TGFβ and/or SMAD2/3 gene is important, especially if the particular region of complementarity in a COL1A1, TGFβ and/or SMAD2/3 gene is known to have polymorphic sequence variation within the population.

In one embodiment, at least one end of a dsRNA has a single-stranded nucleotide overhang of 1 to 4, generally 1 or 2 nucleotides. dsRNAs having at least one nucleotide overhang have unexpectedly superior inhibitory properties relative to their blunt-ended counterparts. In yet another embodiment, the RNA of an iRNA, e.g., a dsRNA, is chemically modified to enhance stability or other beneficial characteristics. The nucleic acids featured in the invention can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, (a) end modifications, e.g., 5' end modifications (phosphorylation, conjugation, inverted linkages, etc.) 3' end modifications (conjugation, DNA nucleotides, inverted linkages, etc.), (b) base modifications, e.g., replacement with stabilizing bases, destabilizing bases, or bases that base pair with an expanded repertoire of partners, removal of bases (abasic nucleotides), or conjugated bases, (c) sugar modifications (e.g., at the 2' position or 4' position) or replacement of the sugar, as well as (d) backbone modifications, including modification or replacement of the phosphodiester linkages. Specific examples of RNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In particular embodiments, the modified RNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. No. RE39464, each of which is herein incorporated by reference Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other embodiments, suitable RNA mimetics suitable are contemplated for use in iRNAs, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$—[known as a methylene(methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$—[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$O$CH_3$, O($CH_2$)$_n$$NH_2$, O($CH_2$)$_n$$CH_3$, O($CH_2$)$_n$O$NH_2$, and O($CH_2$)$_n$ON[($CH_2$)$_n$$CH_3$)]$_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a O($CH_2$)$_2$ON($CH_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$, also described in examples herein below.

Other modifications include 2'-methoxy(2'-O$CH_3$), 2'-aminopropoxy(2'-O$CH_2CH_2CH_2NH_2$) and 2'-fluoro(2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 6,015,886; 6,147,200; 6,166,197; 6,222,025; 6,235,887; 6,380,368; 6,528,640; 6,639,062; 6,617,438; 7,045,610; 7,427,672; and 7,495,088, each of which is herein incorporated by reference, and U.S. Pat. No. 5,750,692, also herein incorporated by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) Nucleic Acids Research 33 (1):439-447; Mook, O R. et al., (2007) Mol Canc Ther 6(3):833-843; Grunweller, A. et al., (2003) Nucleic Acids Research 31(12): 3185-3193).

Representative U.S. Patents that teach the preparation of locked nucleic acid nucleotides include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Another modification of the RNA of an iRNA featured in the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., Proc. Natl. Acid. Sci. USA, 1989, 86: 6553-6556), cholic acid (Manoharan et al., Biorg. Med. Chem. Let., 1994, 4:1053-1060), a thioether, e.g., beryl-S-tritylthiol (Manoharan et al., Ann. N.Y. Acad. Sci., 1992, 660:306-309; Manoharan et al., Biorg. Med. Chem. Let., 1993, 3:2765-2770), a thiocholesterol (Oberhauser et al., Nucl. Acids Res., 1992, 20:533-538), an aliphatic chain, e.g., dodecandiol or undecyl residues (Saison-Behmoaras et al., EMBO J, 1991, 10:1111-1118; Kabanov et al., FEBS Lett., 1990, 259:327-330; Svinarchuk et al., Biochimie, 1993, 75:49-54), a phospholipid, e.g., di-hexadecyl-rac-glycerol or triethyl-ammonium 1,2-di-O-hexadecyl-rac-glycero-3-phosphonate (Manoharan et al., Tetrahedron Lett., 1995, 36:3651-3654; Shea et al., Nucl. Acids Res., 1990, 18:3777-3783), a polyamine or a polyethylene glycol chain (Manoharan et al., Nucleosides & Nucleotides, 1995, 14:969-973), or adamantane acetic acid (Manoharan et al., Tetrahedron Lett., 1995, 36:3651-3654), a palmityl moiety (Mishra et al., Biochim. Biophys. Acta, 1995, 1264:229-237), or an octadecylamine or hexylaminocarbonyloxycholesterol moiety (Crooke et al., J. Pharmacol. Exp. Ther., 1996, 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic stellate cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or TGFβ receptor.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic (PK) modulator. As used herein, a "PK modulator" refers to a pharmacokinetic modulator. PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Lipid Conjugates

In one embodiment, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to modulate, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as HSC in the liver. Also included are HSA and low density lipoprotein (LDL).

Cell Permeation Peptide and Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a definedthree-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 168). An RFGF analogue (e.g., amino acid sequence AALLPVLLAAP (SEQ ID NO: 169)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 170)) and the *Drosophila Antennapedia* protein (RQIKIWFQNRRMK-WKK (SEQ ID NO: 171)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide moiety can be used to target a tumor cell, such as an endothelial tumor cell or a breast cancer tumor cell (Zitzmann et al., Cancer Res., 62:5139-43, 2002). An RGD peptide can facilitate targeting of an dsRNA agent to tumors of a variety of other tissues, including the lung, kidney, spleen, or liver (Aoki et al., Cancer Gene Therapy 8:783-787, 2001). Preferably, the RGD peptide will facili tate targeting of an iRNA agent to the kidney. The RGD peptide can be linear or cyclic, and can be modified, e.g., glycosylated or methylated to facilitate targeting to specific tissues. For example, a glycosylated RGD peptide can deliver a iRNA agent to a tumor cell expressing $\alpha_v\beta_3$ (Haubner et al., Jour. Nucl. Med., 42:326-336, 2001).

Peptides that target markers enriched in proliferating cells can be used, e.g., RGD containing peptides and peptidomimetics can target cancer cells, in particular cells that exhibit an $\alpha v\beta 3$ integrin. Thus, one could use RGD peptides, cyclic peptides containing RGD, RGD peptides that include D-amino acids, as well as synthetic RGD mimics. In addition to RGD, one can use other moieties that target the $\alpha v\beta 3$ integrin ligand. Generally, such ligands can be used to control proliferating cells and angiogenesis.

A "cell permeation peptide" is capable of permeating a cell, e.g., a microbial cell, such as a bacterial or fungal cell, or a mammalian cell, such as a human cell. A microbial cell-permeating peptide can be, for example, a $\alpha$-helical linear peptide (e.g., LL-37 or Ceropin P1), a disulfide bond-containing peptide (e.g., $\alpha$-defensin, $\beta$-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

Carbohydrate Conjugates

In some embodiments, the iRNA oligonucleotides described herein further comprise carbohydrate conjugates. The carbohydrate conjugates are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4-9 monosaccharide units), and polysaccharides such as starches, glycogen, cellulose and polysaccharide gums. Specific monosaccharides include $C_5$ and above (preferably $C_5$-$C_8$) sugars; di- and trisaccharides include sugars having two or three monosaccharide units (preferably $C_5$-$C_8$).

In one embodiment, the carbohydrate conjugate is selected from the group consisting of:

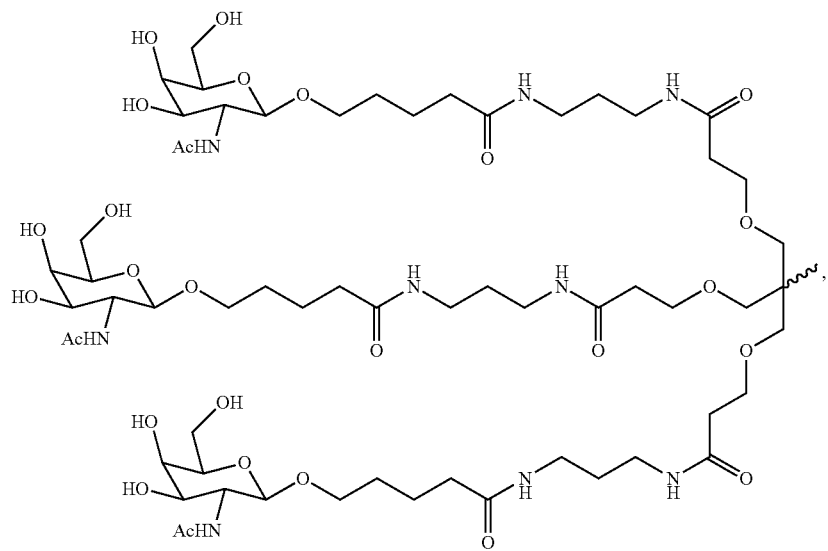
Formula II
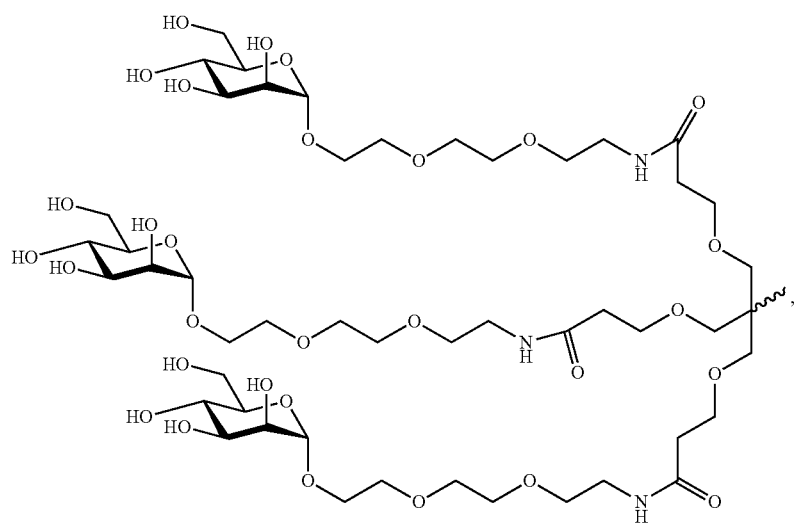
Formula III
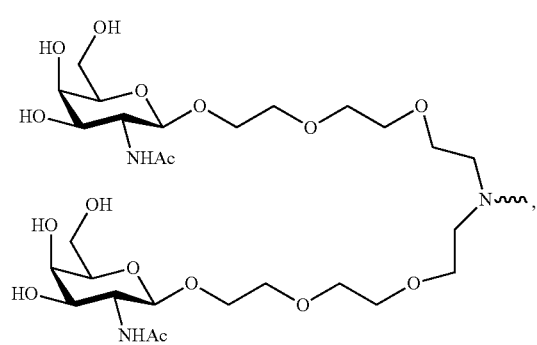
Formula IV

Formula V
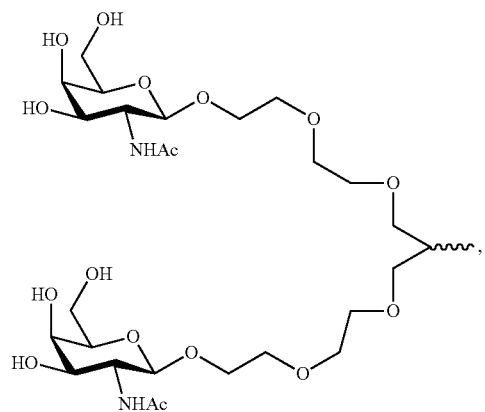
Formula VI
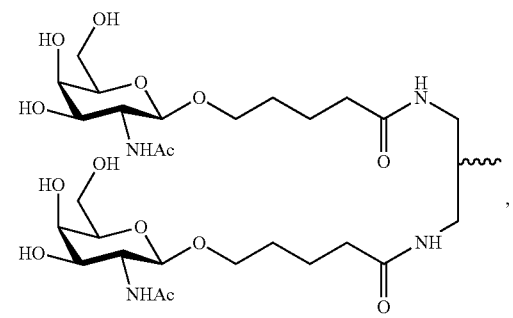
Formula VII
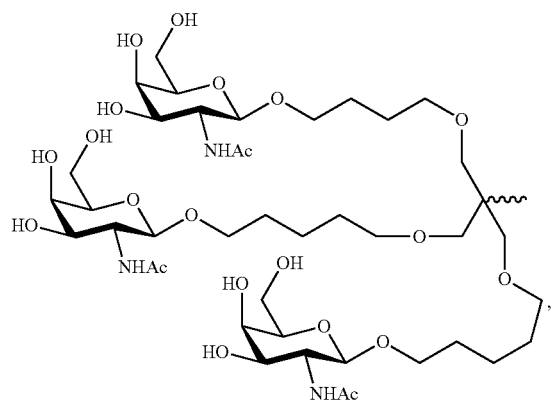
Formula VIII
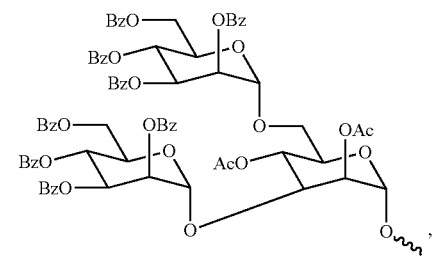
Formula IX
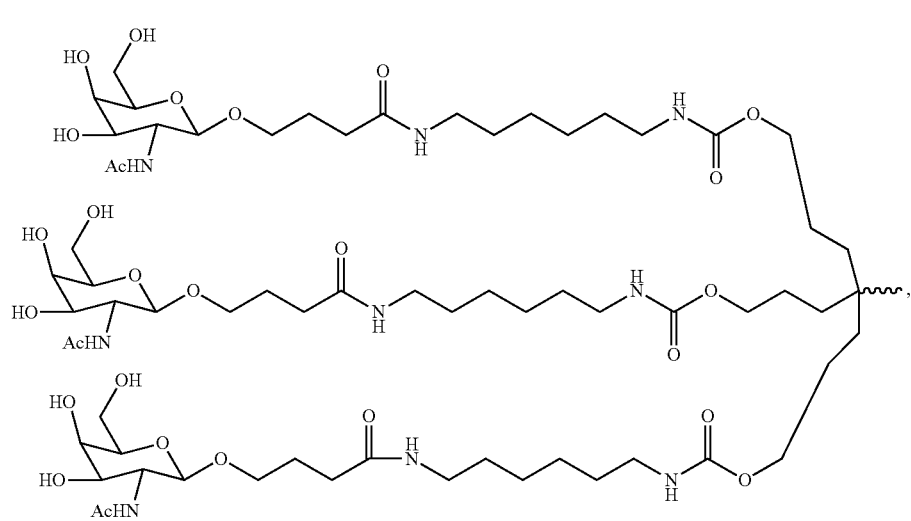

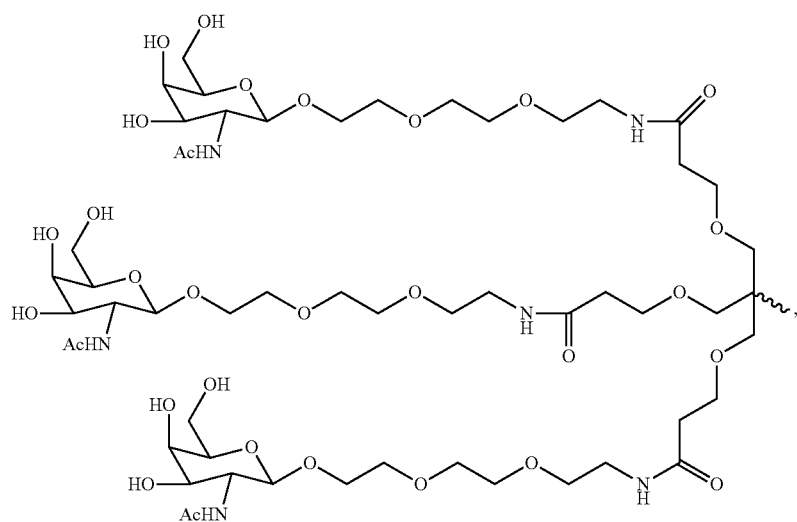
Formula X
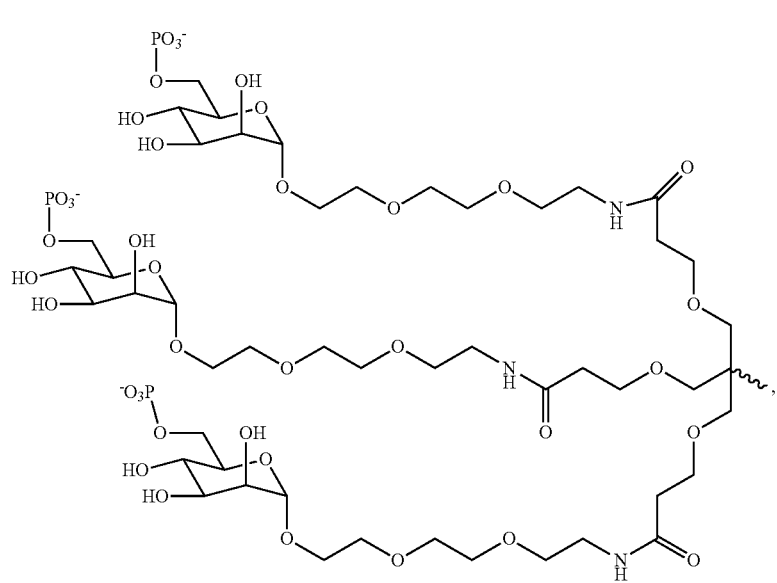
Formula XI

-continued
Formula XII
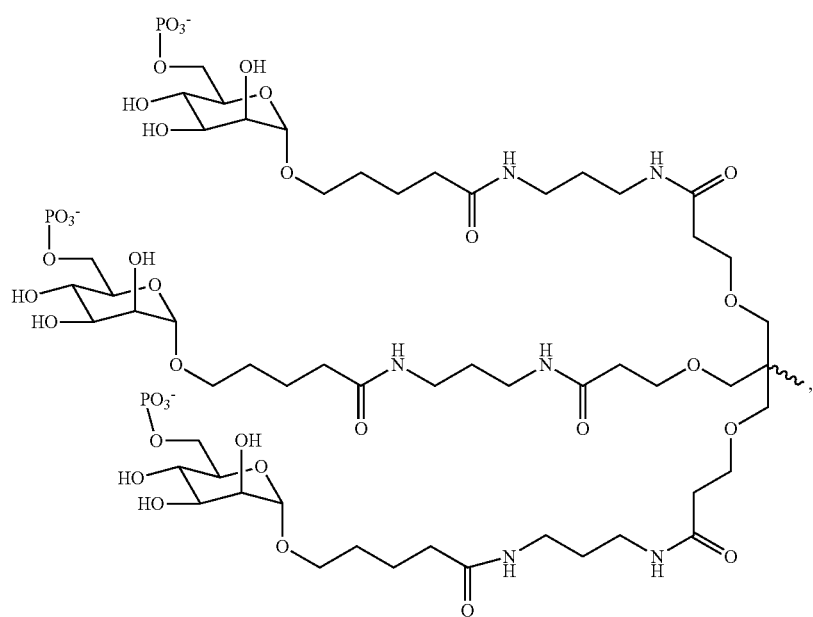
Formula XIII
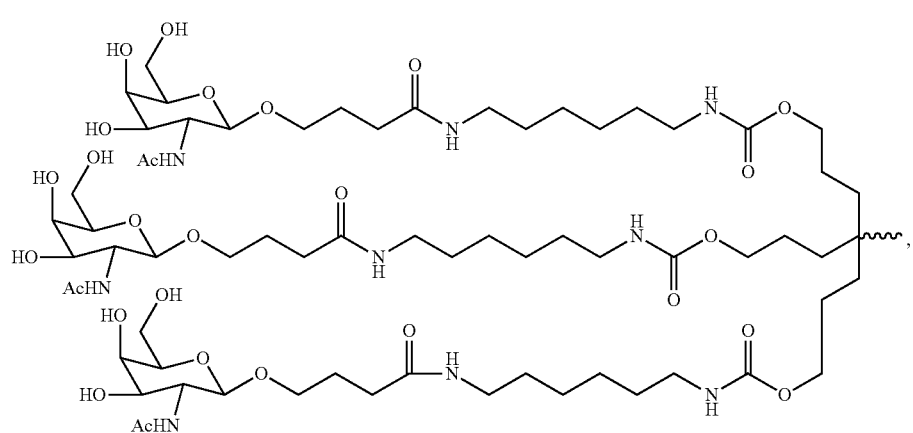
Formula XIV
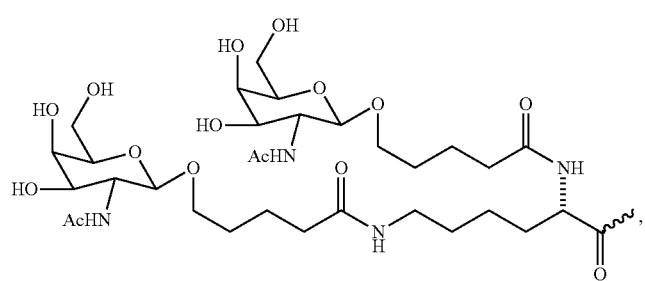
Formula XV
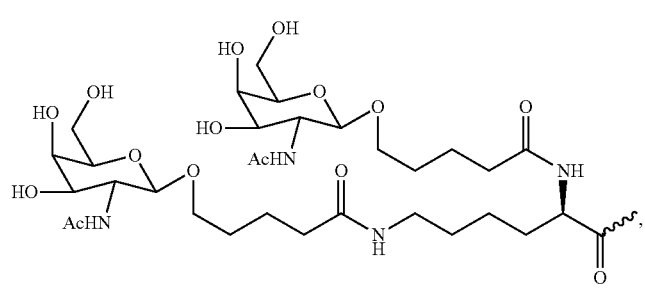

Formula XVI
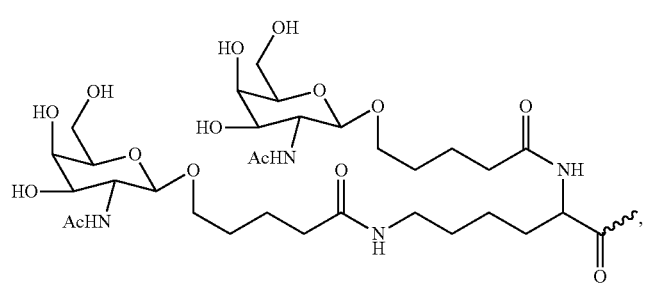
Formula XVII
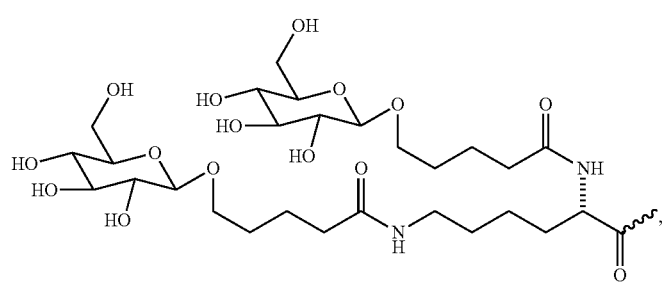
Formula XVIII
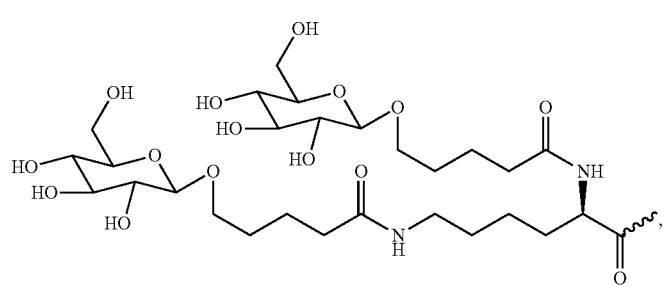
Formula XIX
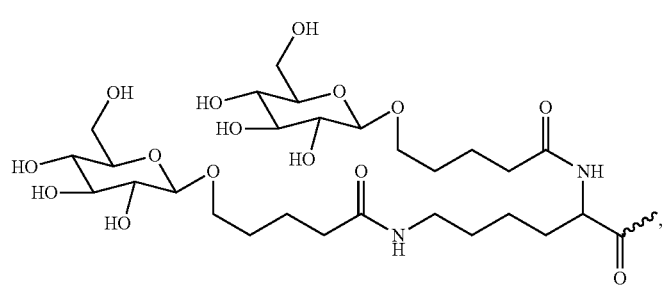

-continued
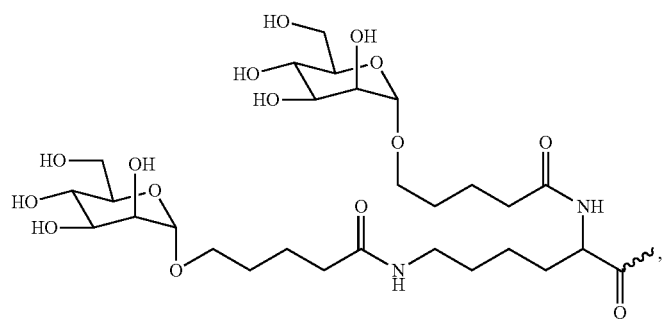
Formula XX
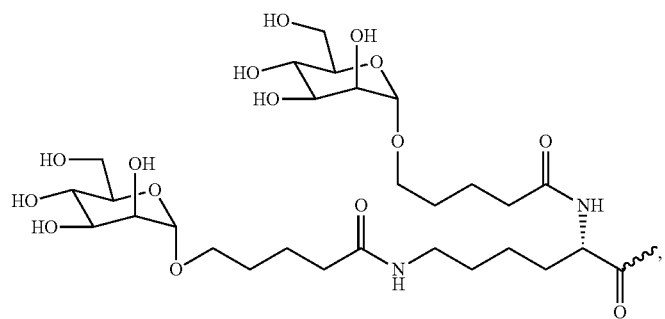
Formula XXI
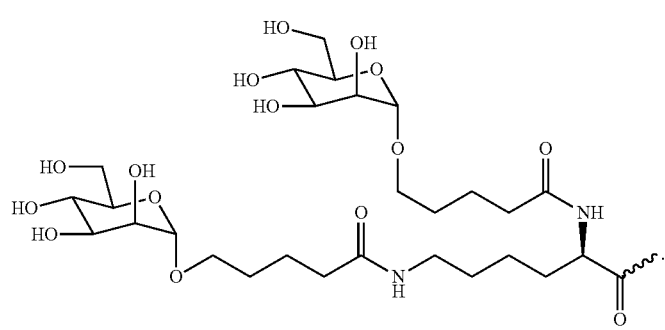
Formula XII, i.e., Formula II-Formula XXII
Another representative carbohydrate conjugate for use in the embodiments described herein includes, but is not limited to,

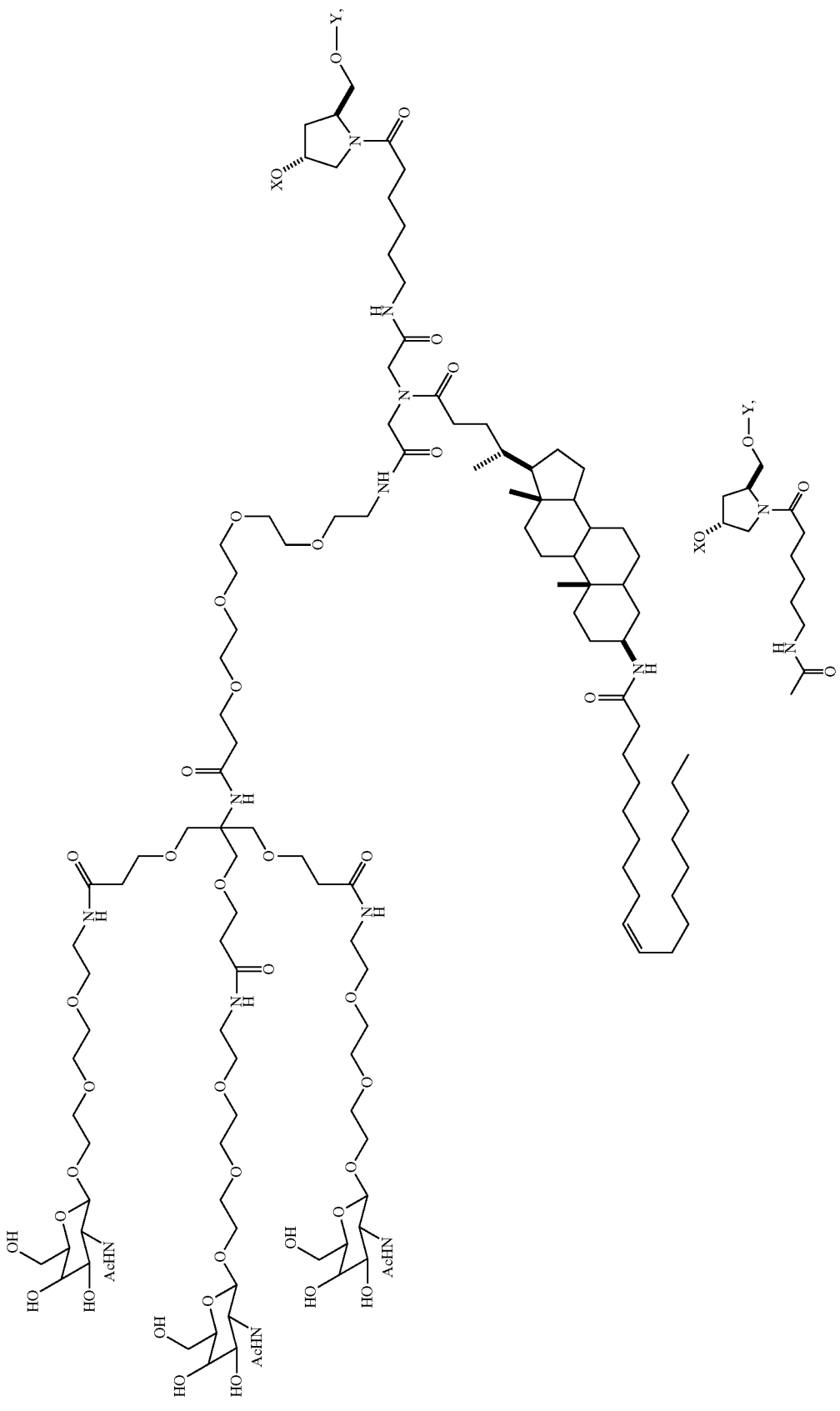
(Formula XXIII)

when one of X or Y is an oligonucleotide, the other is a hydrogen.

In some embodiments, the carbohydrate conjugate further comprises other ligand such as, but not limited to, PK modulator, endosomolytic ligand, and cell permeation peptide.

Linkers

In some embodiments, the conjugates described herein can be attached to the iRNA oligonucleotide with various linkers that can be cleavable or non cleavable.

The term "linker" or "linking group" means an organic moiety that connects two parts of a compound. Linkers typically comprise a direct bond or an atom such as oxygen or sulfur, a unit such as $NR^8$, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, $N(R^8)$, C(O), substituted or unsubstituted aryl, substituted or unsubstituted heteroaryl, substituted or unsubstituted heterocyclic; where $R^8$ is hydrogen, acyl, aliphatic or substituted aliphatic. In one embodiment, the linker is between 1-24 atoms, preferably 4-24 atoms, preferably 6-18 atoms, more preferably 8-18 atoms, and most preferably 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least 10 times or more, preferably at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing the cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, liver targeting ligands can be linked to the cationic lipids through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least 2, 4, 10 or 100 times faster in the cell (or under in vitro conditions selected to mimic intracellular conditions) as compared to blood or serum (or under in vitro conditions selected to mimic extracellular conditions).

Redox Cleavable Linking Groups

One class of cleavable linking groups are redox cleavable linking groups that are cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In a preferred embodiment, candidate compounds are cleaved by at most 10% in the blood. In preferred embodiments, useful candidate compounds are degraded at least 2, 4, 10 or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

Phosphate-Based Cleavable Linking Groups

Phosphate-based cleavable linking groups are cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

Acid Cleavable Linking Groups

Acid cleavable linking groups are linking groups that are cleaved under acidic conditions. In preferred embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

Ester-Based Linking Groups

Ester-based cleavable linking groups are cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

Peptide-Based Cleaving Groups

Peptide-based cleavable linking groups are cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHR$^A$C(O)NHCHR$^B$C(O)— (SEQ ID NO: 876), where R$^A$ and R$^B$ are the R groups of the two adjacent amino acids. These candidates can be evaluated using methods analogous to those described above.

Representative carbohydrate conjugates with linkers include, but are not limited to,

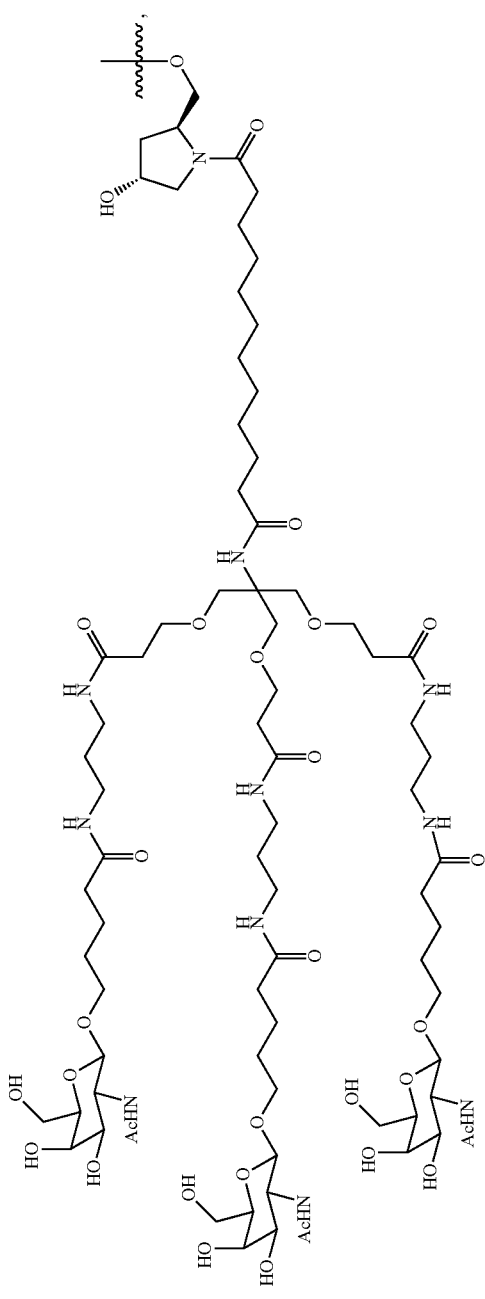
(Formula XXIV)
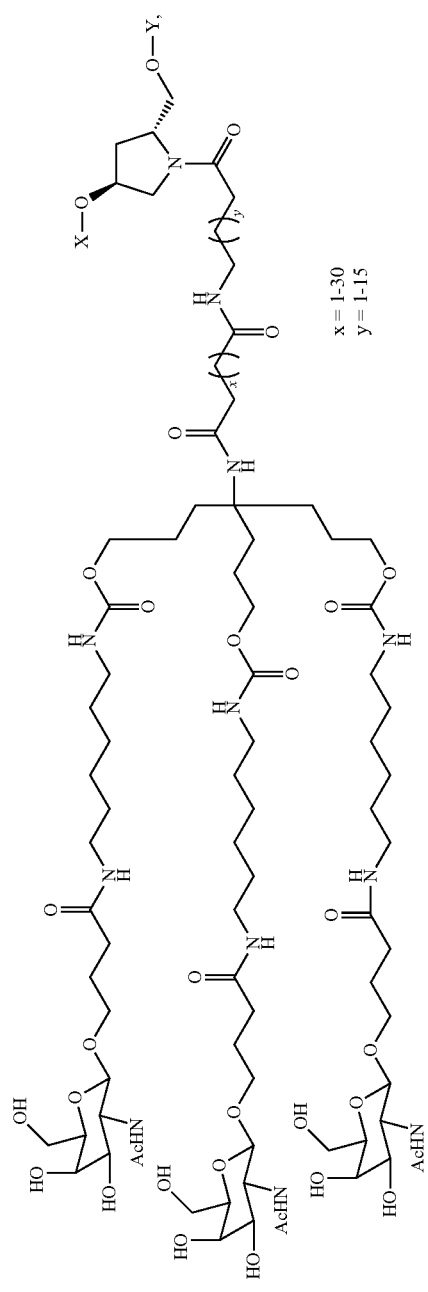
(Formula XXV)
x = 1-30
y = 1-15

-continued
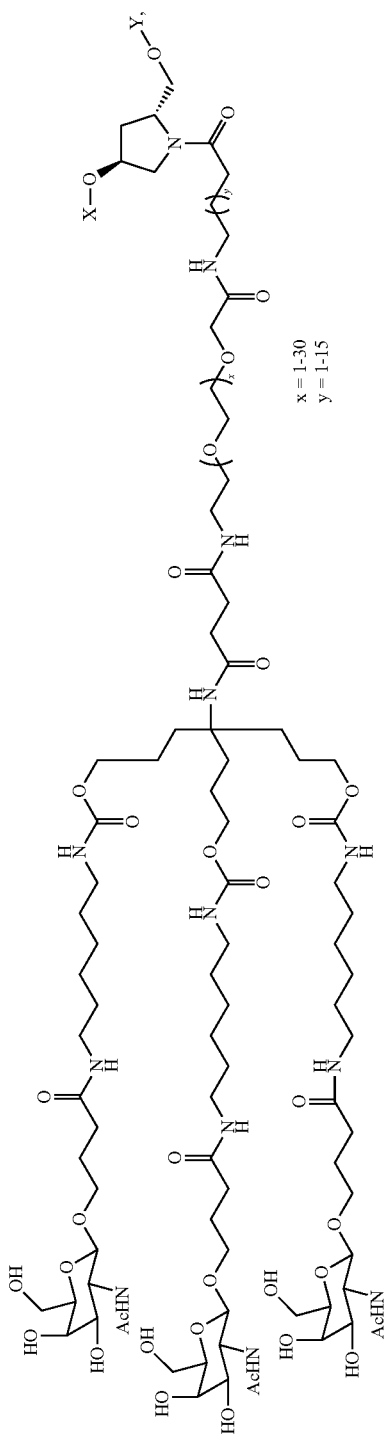
(Formula XXVI)
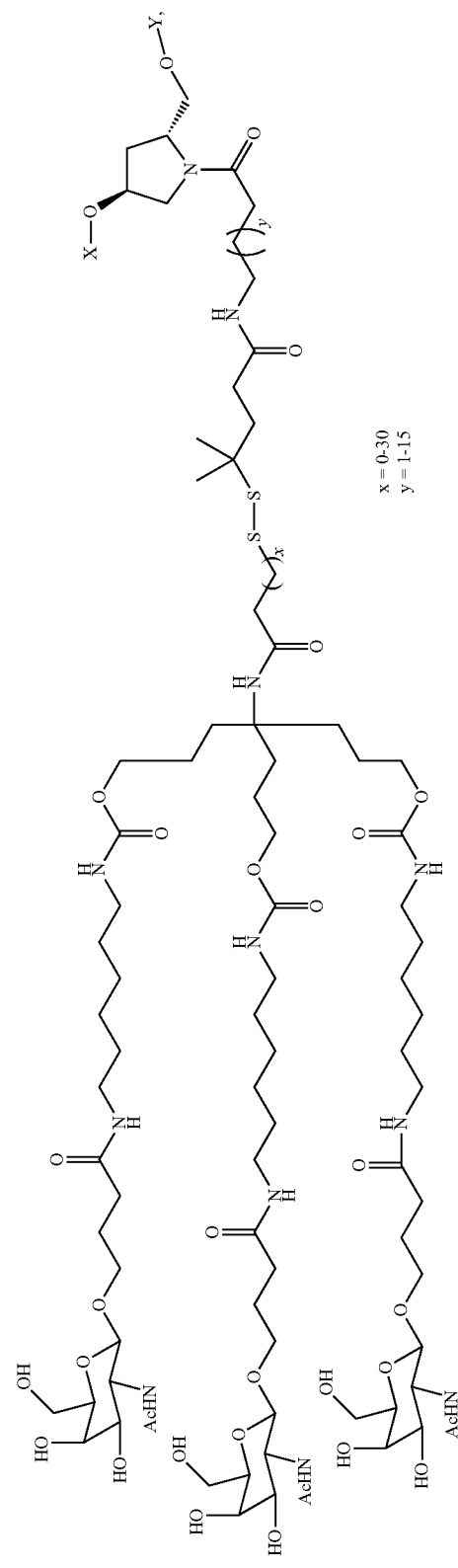
(Formula XXVII)

-continued
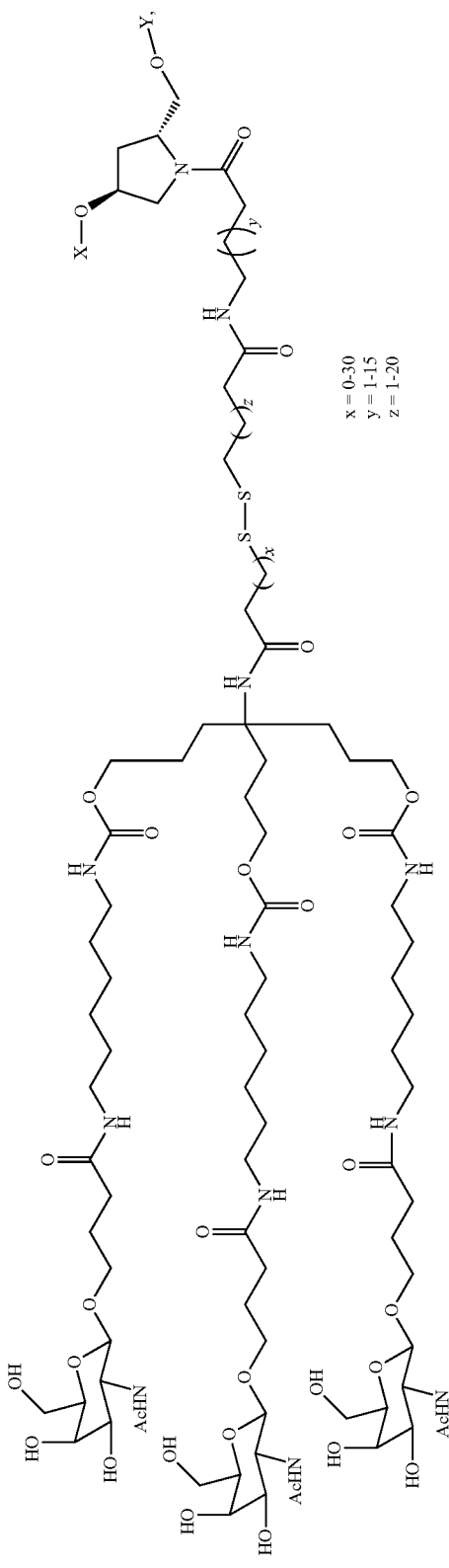
(Formula XXVIII)
x = 0-30
y = 1-15
z = 1-20
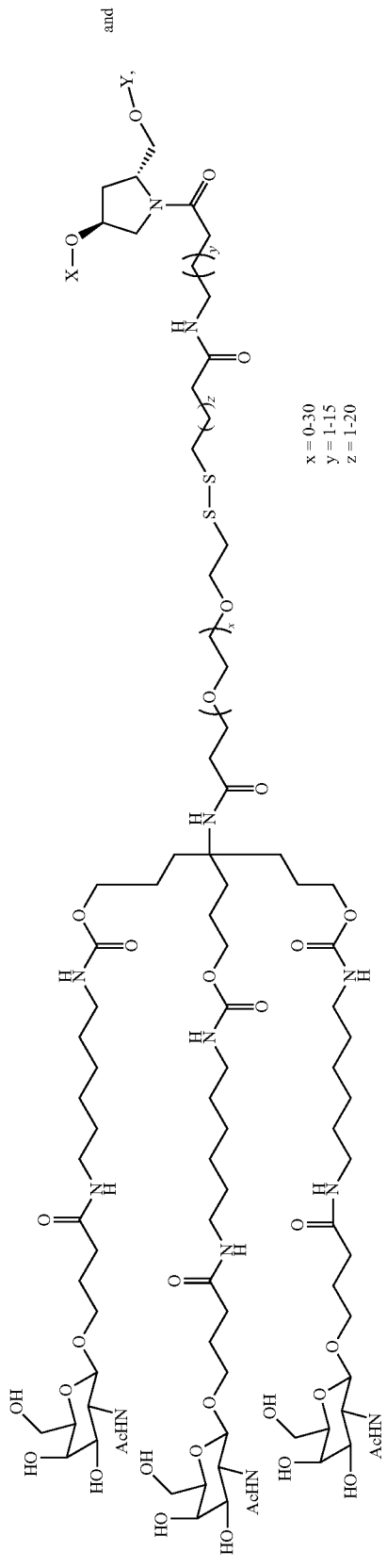
and
(Formula XXIX)
x = 0-30
y = 1-15
z = 1-20

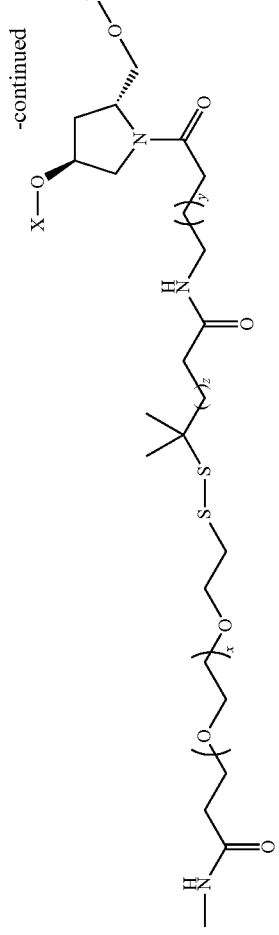
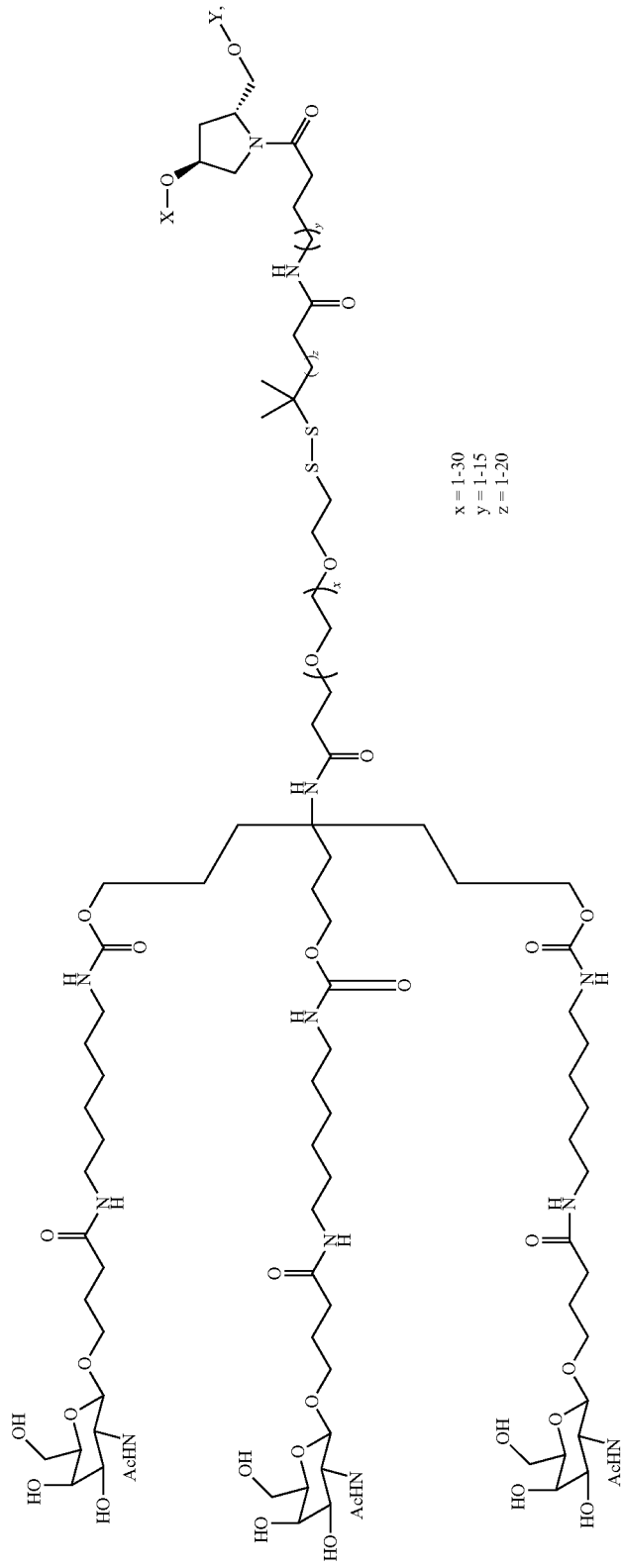
(Formula XXXX)

when one of X or Y is an oligonucleotide, the other is a hydrogen.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; each of which is herein incorporated by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds. "Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., Biochem. Biophys. Res. Comm., 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-5-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

Delivery of iRNA

The delivery of an iRNA to a subject in need thereof can be achieved in a number of different ways. In vivo delivery can be performed directly by administering a composition comprising an iRNA, e.g. a dsRNA, to a subject. Alternatively, delivery can be performed indirectly by administering one or more vectors that encode and direct the expression of the iRNA. These alternatives are discussed further below.

Direct Delivery

In general, any method of delivering a nucleic acid molecule can be adapted for use with an iRNA (see e.g., Akhtar S, and Julian R L., 1992, Trends Cell. Biol. 2 (5):139-144 and WO94/02595, which are incorporated herein by reference in their entireties). However, there are three factors that are important to consider in order to successfully deliver an iRNA molecule in vivo: (a) biological stability of the delivered molecule, (2) preventing non-specific effects, and (3) accumulation of the delivered molecule in the target tissue. The non-specific effects of an iRNA can be minimized by local administration, for example by direct injection or implantation into a tissue (as a non-limiting example, a tumor) or topically administering the preparation. Local administration to a treatment site maximizes local concentration of the agent, limits the exposure of the agent to systemic tissues that may otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) Retina 24:132-138) and subretinal injections in mice (Reich, S J., et al (2003) Mol. Vis. 9:210-216) were both shown to prevent neovascularization in an experimental model of age-related macular degeneration. In addition, direct intratumoral injection of a dsRNA in mice reduces tumor volume (Pille, J., et al (2005) Mol. Ther. 11:267-274) and can prolong survival of tumor-bearing mice (Kim, W J., et al (2006) Mol. Ther. 14:343-350; Li, S., et al (2007) Mol. Ther. 15:515-523). RNA interference has also shown success with local delivery to the CNS by direct injection (Dorn, G., et al. (2004) Nucleic Acids 32:e49; Tan, P H., et al (2005) Gene Ther. 12:59-66; Makimura, H., et al (2002) BMC Neurosci. 3:18; Shishkina, G T., et al (2004) Neuroscience 129:521-528; Thakker, E R., et al (2004) Proc. Natl. Acad. Sci. U.S.A. 101:17270-17275; Akaneya, Y., et al (2005) J. Neurophysiol. 93:594-602) and to the lungs by intranasal administration (Howard, K A., et al (2006) Mol. Ther. 14:476-484; Zhang, X., et al (2004) J.

Biol. Chem. 279:10677-10684; Bitko, V., et al (2005) Nat. Med. 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) Nature 432:173-178). Conjugation of an iRNA to an aptamer has been shown to inhibit tumor growth and mediate tumor regression in a mouse model of prostate cancer (McNamara, J O., et al (2006) Nat. Biotechnol. 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) Journal of Controlled Release 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003) J. Mol. Biol. 327: 761-766; Verma, U N., et al (2003) Clin. Cancer Res. 9:1291-1300; Arnold, A S et al (2007) J. Hypertens. 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) Nature 441:111-114), cardiolipin (Chien, P Y., et al (2005) Cancer Gene Ther. 12:321-328; Pal, A., et al (2005) Int J. Oncol. 26:1087-1091), polyethyleneimine (Bonnet M E., et al (2008) Pharm. Res. Aug 16 Epub ahead of print; Aigner, A. (2006) J. Biomed. Biotechnol. 71659), Arg-Gly-Asp (RGD) peptides (Liu, S. (2006) Mol. Pharm. 3:472-487), and polyamidoamines (Tomalia, D A., et al (2007) Biochem. Soc. Trans. 35:61-67; Yoo, H., et al (1999) Pharm. Res. 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

Vector Encoded dsRNAs

In another aspect, iRNA targeting the COL1A1, TGFβ and/or SMAD2/3 gene can be expressed from transcription units inserted into DNA or RNA vectors (see, e.g., Couture, A, et al., *TIG.,* 1996, 12:5-10; Skillern, A., et al., International PCT Publication No. WO 00/22113, Conrad, PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA,* 1995, 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

iRNA expression plasmids can be transfected into target cells as a complex with cationic lipid carriers (e.g., Oligofectamine) or non-cationic lipid-based carriers (e.g., Transit-TKO™). Multiple lipid transfections for iRNA-mediated knockdowns targeting different regions of a target RNA over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, FASEB J. 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-beta-D1-thiogalactopyranoside (IPTG). A person skilled in the art would be able to choose the appropriate regulatory/promoter sequence based on the intended use of the iRNA transgene.

In a specific embodiment, viral vectors that contain nucleic acid sequences encoding an iRNA can be used. For example, a retroviral vector can be used (see Miller et al., Meth. Enzymol. 217:581-599 (1993)). These retroviral vectors contain the components necessary for the correct packaging of the viral genome and integration into the host cell DNA. The nucleic acid sequences encoding an iRNA are cloned into one or more vectors, which facilitates delivery of the nucleic acid into a patient. More detail about retroviral vectors can be found, for example, in Boesen et al., Biotherapy 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., J. Clin. Invest. 93:644-651 (1994); Kiem et al., Blood 83:1467-1473 (1994); Salmons and Gunzberg, Human Gene Therapy 4:129-141 (1993); and Grossman and Wilson, Curr. Opin. in Genetics and Devel. 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, Current Opinion in Genetics and Development 3:499-503 (1993) present a review of adenovirus-based gene therapy. Bout et al., Human Gene Therapy 5:3-10 (1994) demonstrated the use of adenovirus vectors to transfer genes to the respiratory epithelia of rhesus monkeys. Other instances of the use of adenoviruses in gene therapy can be found in Rosenfeld et al., Science 252:431-434 (1991); Rosenfeld et al., Cell 68:143-155 (1992); Mastrangeli et al., J. Clin. Invest. 91:225-234 (1993); PCT Publication WO94/12649; and Wang, et al., Gene Therapy 2:775-783 (1995). A suitable AV vector for expressing an iRNA featured in the invention, a method for constructing the recombinant AV vector, and a method for delivering the vector into target cells, are described in Xia H et al. (2002), Nat. Biotech. 20: 1006-1010.

Use of Adeno-associated virus (AAV) vectors is also contemplated (Walsh et al., Proc. Soc. Exp. Biol. Med. 204:289-300 (1993); U.S. Pat. No. 5,436,146). In one embodiment, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the invention, methods for constructing the recombinant AV vector, and methods for delivering the vectors into target cells are described in Samulski R et al. (1987), J. Virol. 61: 3096-3101; Fisher K J et al. (1996), J. Virol. 70: 520-532; Samulski R et al. (1989), J. Virol. 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

Another preferred viral vector is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), J Virol 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

III. Pharmaceutical Compositions Containing iRNA

In one embodiment, provided herein are pharmaceutical compositions containing an iRNA and a pharmaceutically acceptable carrier. The pharmaceutical composition containing the iRNA is useful for treating hepatic fibrosis related to the overexpression a COL1A1 gene. Such pharmaceutical compositions are formulated based on the mode of delivery. One example is compositions that are formulated for systemic administration via parenteral delivery, e.g., by intravenous (IV) delivery. Another example is compositions that are formulated for direct delivery into the brain parenchyma, e.g., by infusion into the brain, such as by continuous pump infusion.

The pharmaceutical compositions featured herein are administered in dosages sufficient to inhibit expression of COL1A1, TGFβ and/or SMAD2/3 genes. In general, a suitable dose of iRNA will be in the range of 0.01 to 200.0 milligrams per kilogram body weight of the recipient per day, generally in the range of 1 to 50 mg per kilogram body weight per day. For example, the dsRNA can be administered at 0.05 mg/kg, 0.5 mg/kg, 1 mg/kg, 1.5 mg/kg, 2 mg/kg, 3 mg/kg, 10 mg/kg, 20 mg/kg, 30 mg/kg, 40 mg/kg, or 50 mg/kg per single dose. The pharmaceutical composition can be administered once daily or the iRNA can be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as could be used with the agents of the present invention. In this embodiment, the dosage unit contains a corresponding multiple of the daily dose.

The effect of a single dose on COL1A1, TGFβ and/or SMAD2/3 levels can be long lasting, such that subsequent doses are administered at not more than 3, 4, or 5 day intervals, or at not more than 1, 2, 3, or 4 week intervals.

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

A number of mouse models for the study of liver fibrosis of various causes are available, for example, as carbon tetrachloride ($CCl_4$), diethylnitrosamine and thioacetamide-treated mouse models. Such models can be used for in vivo testing of iRNA, as well as for determining a therapeutically effective dose.

The present invention also includes pharmaceutical compositions and formulations that include the iRNA compounds featured in the invention. The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as the liver (e.g., the HSCs of the liver).

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

Liposomal Formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to traverse intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent can act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al. S.T.P.Pharma. Sci., 1994, 4(6):466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside GM1 or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describes PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes can include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Nucleic Acid Lipid Particles

In one embodiment, a COL1A1, TGFβ and SMAD2/3 dsRNA featured in the invention is fully encapsulated in the lipid formulation, e.g., to form a SPLP, pSPLP, SNALP, or other nucleic acid-lipid particle. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SNALPs and SPLPs typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection and accumulate at distal sites (e.g., sites physically separated from the administration site). SPLPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1.

The cationic lipid can be, for example, N,N-dioleyl-N,N-dimethylammonium chloride (DODAC), N,N-distearyl-N,N-dimethylammonium bromide (DDAB), N-(1-(2,3-dioleoyloxy)propyl)-N,N,N-trimethylammonium chloride (DOTAP), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1), or a mixture thereof. The cationic lipid can comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S.

provisional patent application No. 61/107,998 filed on Oct. 23, 2008, which is herein incorporated by reference.

In one embodiment, the lipid-siRNA particle includes 40% 2,2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($C_{i_2}$), a PEG-dimyristyloxypropyl ($C_{i_4}$), a PEG-dipalmityloxypropyl ($C_{i_6}$), or a PEG-distearyloxypropyl ($C]_8$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

LNP01

In one embodiment, the lipidoid ND98.4HCl (MW 1487) (see U.S. patent application Ser. No. 12/056,230, filed Mar. 26, 2008, which is herein incorporated by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula I

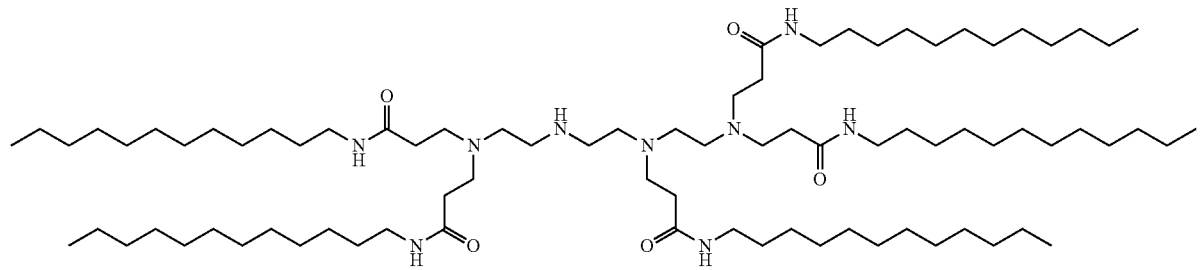

ND98 Isomer I

LNP01 formulations are described, e.g., in International Application Publication No. WO 2008/042973, which is hereby incorporated by reference.

Additional exemplary lipid-dsRNA formulations are as follows:

| | Cationic Lipid | cationic lipid/non-cationic lipid/cholesterol/PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |
| S-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200) | C12-200/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)

SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described, e.g., in U.S. Provisional Ser. No. 61/148,366, filed Jan. 29, 2009; U.S. Provisional Ser. No. 61/156,851, filed Mar. 2, 2009; U.S. Provisional Serial No. filed Jun. 10, 2009; U.S. Provisional Ser. No. 61/228,373, filed Jul. 24, 2009; U.S. Provisional Ser. No. 61/239,686, filed Sep. 3, 2009, and International Application No. PCT/US2010/022614, filed Jan. 29, 2010, which are hereby incorporated by reference.

MC3 comprising formulations are described, e.g., in U.S. Provisional Ser. No. 61/244,834, filed Sep. 22, 2009, U.S. Provisional Ser. No. 61/185,800, filed Jun. 10, 2009, and International Application No. PCT/US10/28224, filed Jun. 10, 2010, which are hereby incorporated by reference.

ALNY-100 comprising formulations are described, e.g., International patent application number PCT/US09/63933, filed on Nov. 10, 2009, which is hereby incorporated by reference.

C12-200 comprising formulations are described in U.S. Provisional Ser. No. 61/175,770, filed May 5, 2009 and International Application No. PCT/US10/33777, filed May 5, 2010, which are hereby incorporated by reference.

Synthesis of Cationic Lipids

Any of the compounds, e.g., cationic lipids and the like, used in the nucleic acid-lipid particles of the invention can be prepared by known organic synthesis techniques, including the methods described in more detail in the Examples. All substituents are as defined below unless indicated otherwise.

"Alkyl" means a straight chain or branched, noncyclic or cyclic, saturated aliphatic hydrocarbon containing from 1 to 24 carbon atoms. Representative saturated straight chain alkyls include methyl, ethyl, n-propyl, n-butyl, n-pentyl, n-hexyl, and the like; while saturated branched alkyls include isopropyl, sec-butyl, isobutyl, tert-butyl, isopentyl, and the like. Representative saturated cyclic alkyls include cyclopropyl, cyclobutyl, cyclopentyl, cyclohexyl, and the like; while unsaturated cyclic alkyls include cyclopentenyl and cyclohexenyl, and the like.

"Alkenyl" means an alkyl, as defined above, containing at least one double bond between adjacent carbon atoms. Alkenyls include both cis and trans isomers. Representative straight chain and branched alkenyls include ethylenyl, propylenyl, 1-butenyl, 2-butenyl, isobutylenyl, 1-pentenyl, 2-pentenyl, 3-methyl-1-butenyl, 2-methyl-2-butenyl, 2,3-dimethyl-2-butenyl, and the like.

"Alkynyl" means any alkyl or alkenyl, as defined above, which additionally contains at least one triple bond between adjacent carbons. Representative straight chain and branched alkynyls include acetylenyl, propynyl, 1-butynyl, 2-butynyl, 1-pentynyl, 2-pentynyl, 3-methyl-1 butynyl, and the like.

"Acyl" means any alkyl, alkenyl, or alkynyl wherein the carbon at the point of attachment is substituted with an oxo group, as defined below. For example, —C(=O)alkyl, —C(=O)alkenyl, and —C(=O)alkynyl are acyl groups.

"Heterocycle" means a 5- to 7-membered monocyclic, or 7- to 10-membered bicyclic, heterocyclic ring which is either saturated, unsaturated, or aromatic, and which contains from 1 or 2 heteroatoms independently selected from nitrogen, oxygen and sulfur, and wherein the nitrogen and sulfur heteroatoms can be optionally oxidized, and the nitrogen heteroatom can be optionally quaternized, including bicyclic rings in which any of the above heterocycles are fused to a benzene ring. The heterocycle can be attached via any heteroatom or carbon atom. Heterocycles include heteroaryls as defined below. Heterocycles include morpholinyl, pyrrolidinonyl, pyrrolidinyl, piperidinyl, piperizynyl, hydantoinyl, valerolactamyl, oxiranyl, oxetanyl, tetrahydrofuranyl, tetrahydropyranyl, tetrahydropyridinyl, tetrahydroprimidinyl, tetrahydrothiophenyl, tetrahydrothiopyranyl, tetrahydropyrimidinyl, tetrahydrothiophenyl, tetrahydrothiopyranyl, and the like.

The terms "optionally substituted alkyl", "optionally substituted alkenyl", "optionally substituted alkynyl", "optionally substituted acyl", and "optionally substituted heterocycle" means that, when substituted, at least one hydrogen atom is replaced with a substituent. In the case of an oxo substituent (=O) two hydrogen atoms are replaced. In this regard, substituents include oxo, halogen, heterocycle, —CN, —OR$^x$, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$ and —SO$_n$NR$^x$R$^y$, wherein n is 0, 1 or 2, R$^x$ and R$^y$ are the same or different and independently hydrogen, alkyl or heterocycle, and each of said alkyl and heterocycle substituents can be further substituted with one or more of oxo, halogen, —OH, —CN, alkyl, —OR$^x$, heterocycle, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$ and —SO$_n$NR$^x$R$^y$.

"Halogen" means fluoro, chloro, bromo and iodo.

In some embodiments, the methods of the invention can require the use of protecting groups. Protecting group methodology is well known to those skilled in the art (see, for example, Protective Groups in Organic Synthesis, Green, T. W. et al., Wiley-Interscience, New York City, 1999). Briefly, protecting groups within the context of this invention are any group that reduces or eliminates unwanted reactivity of a functional group. A protecting group can be added to a functional group to mask its reactivity during certain reactions and then removed to reveal the original functional group. In some embodiments an "alcohol protecting group" is used. An "alcohol protecting group" is any group which decreases or eliminates unwanted reactivity of an alcohol functional group. Protecting groups can be added and removed using techniques well known in the art.

Synthesis of Formula A

In some embodiments, nucleic acid-lipid particles of the invention are formulated using a cationic lipid of formula A:

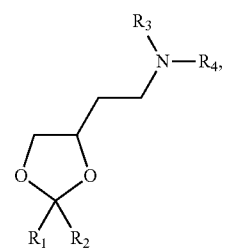

where R1 and R2 are independently alkyl, alkenyl or alkynyl, each can be optionally substituted, and R3 and R4 are independently lower alkyl or R3 and R4 can be taken together to form an optionally substituted heterocyclic ring. In some embodiments, the cationic lipid is XTC (2,2-Dilinoleyl-4-dimethylaminoethyl-[1,3]-dioxolane). In general, the lipid of formula A above can be made by the following Reaction Schemes 1 or 2, wherein all substituents are as defined above unless indicated otherwise.

of 1 and 2 yields ketal 3. Treatment of ketal 3 with amine 4 yields lipids of formula A. The lipids of formula A can be converted to the corresponding ammonium salt with an organic salt of formula 5, where X is anion counter ion selected from halogen, hydroxide, phosphate, sulfate, or the like.

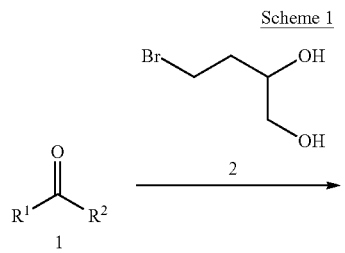

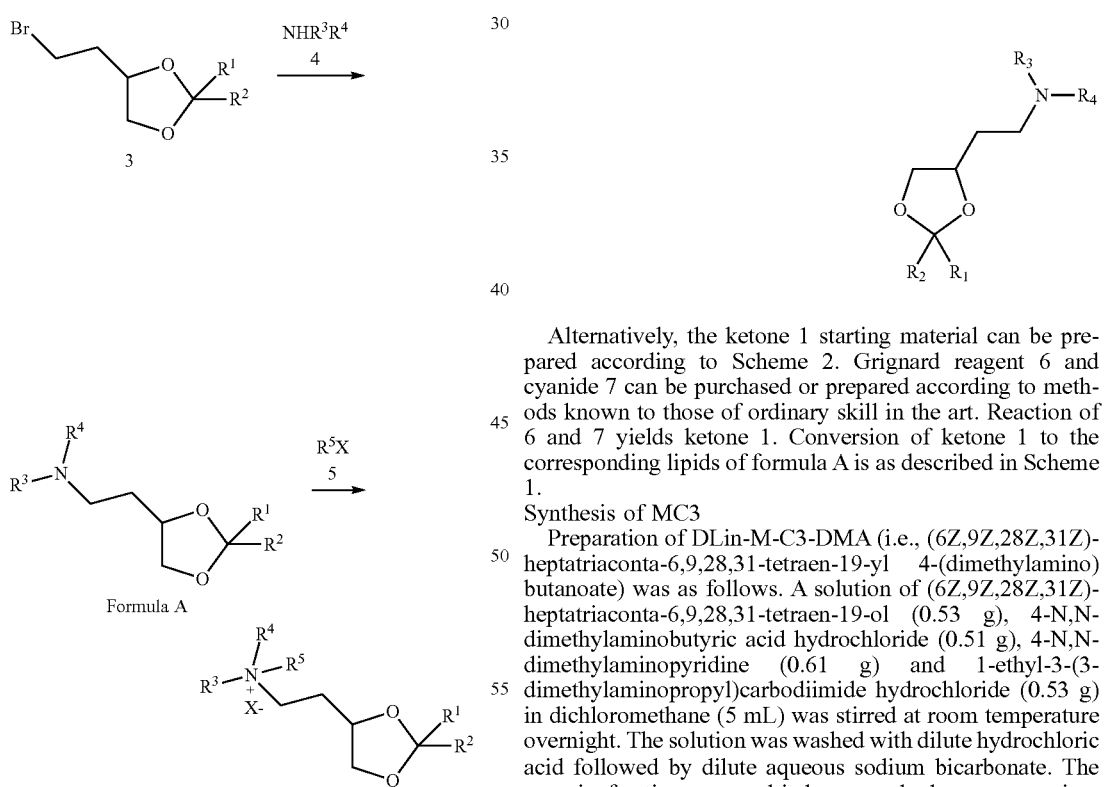

Lipid A, where $R_1$ and $R_2$ are independently alkyl, alkenyl or alkynyl, each can be optionally substituted, and $R_3$ and $R_4$ are independently lower alkyl or $R_3$ and $R_4$ can be taken together to form an optionally substituted heterocyclic ring, can be prepared according to Scheme 1. Ketone 1 and bromide 2 can be purchased or prepared according to methods known to those of ordinary skill in the art. Reaction Alternatively, the ketone 1 starting material can be prepared according to Scheme 2. Grignard reagent 6 and cyanide 7 can be purchased or prepared according to methods known to those of ordinary skill in the art. Reaction of 6 and 7 yields ketone 1. Conversion of ketone 1 to the corresponding lipids of formula A is as described in Scheme 1.

Synthesis of MC3

Preparation of DLin-M-C3-DMA (i.e., (6Z,9Z,28Z,31Z)-heptatriaconta-6,9,28,31-tetraen-19-yl 4-(dimethylamino) butanoate) was as follows. A solution of (6Z,9Z,28Z,31Z)-heptatriaconta-6,9,28,31-tetraen-19-ol (0.53 g), 4-N,N-dimethylaminobutyric acid hydrochloride (0.51 g), 4-N,N-dimethylaminopyridine (0.61 g) and 1-ethyl-3-(3-dimethylaminopropyl)carbodiimide hydrochloride (0.53 g) in dichloromethane (5 mL) was stirred at room temperature overnight. The solution was washed with dilute hydrochloric acid followed by dilute aqueous sodium bicarbonate. The organic fractions were dried over anhydrous magnesium sulphate, filtered and the solvent removed on a rotovap. The residue was passed down a silica gel column (20 g) using a 1-5% methanol/dichloromethane elution gradient. Fractions containing the purified product were combined and the solvent removed, yielding a colorless oil (0.54 g).

Synthesis of ALNY-100

Synthesis of ketal 519 [ALNY-100] was performed using the following scheme 3:

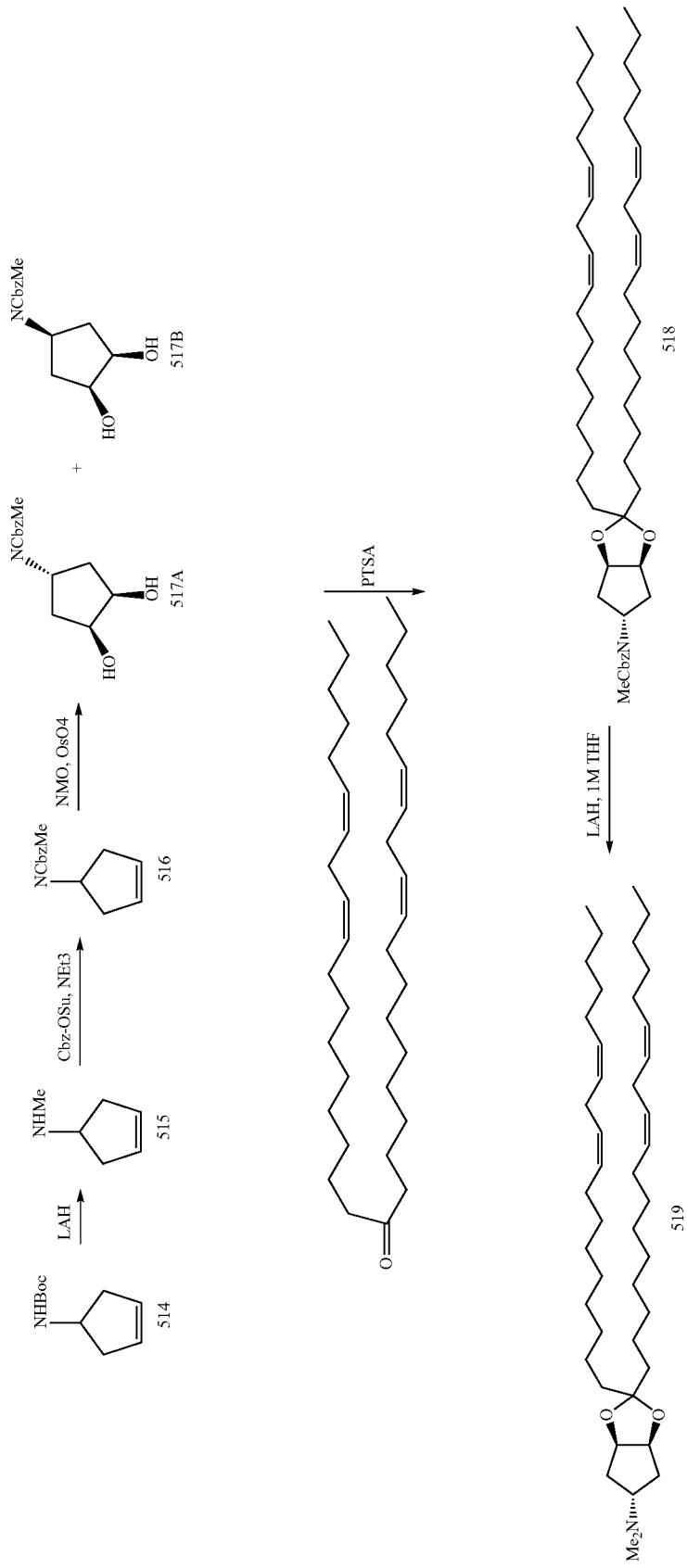

Synthesis of 515

To a stirred suspension of LiAlH4 (3.74 g, 0.09852 mol) in 200 ml anhydrous THF in a two neck RBF (1 L), was added a solution of 514 (10 g, 0.04926 mol) in 70 mL of THF slowly at 0° C. under nitrogen atmosphere. After complete addition, reaction mixture was warmed to room temperature and then heated to reflux for 4 h. Progress of the reaction was monitored by TLC. After completion of reaction (by TLC) the mixture was cooled to 0° C. and quenched with careful addition of saturated Na2SO4 solution. Reaction mixture was stirred for 4 h at room temperature and filtered off. Residue was washed well with THF. The filtrate and washings were mixed and diluted with 400 mL dioxane and 26 mL conc. HCl and stirred for 20 minutes at room temperature. The volatilities were stripped off under vacuum to furnish the hydrochloride salt of 515 as a white solid. Yield: 7.12 g 1H-NMR (DMSO, 400 MHz): δ=9.34 (broad, 2H), 5.68 (s, 2H), 3.74 (m, 1H), 2.66-2.60 (m, 2H), 2.50-2.45 (m, 5H).

Synthesis of 516

To a stirred solution of compound 515 in 100 mL dry DCM in a 250 mL two neck RBF, was added NEt3 (37.2 mL, 0.2669 mol) and cooled to 0° C. under nitrogen atmosphere. After a slow addition of N-(benzyloxy-carbonyloxy)-succinimide (20 g, 0.08007 mol) in 50 mL dry DCM, reaction mixture was allowed to warm to room temperature. After completion of the reaction (2-3 h by TLC) mixture was washed successively with 1N HCl solution (1×100 mL) and saturated NaHCO3 solution (1×50 mL). The organic layer was then dried over anhyd. Na2SO4 and the solvent was evaporated to give crude material which was purified by silica gel column chromatography to get 516 as sticky mass. Yield: 11 g (89%). 1H-NMR (CDCl3, 400 MHz): δ=7.36-7.27 (m, 5H), 5.69 (s, 2H), 5.12 (s, 2H), 4.96 (br., 1H) 2.74 (s, 3H), 2.60 (m, 2H), 2.30-2.25 (m, 2H). LC-MS [M+H] −232.3 (96.94%).

Synthesis of 517A and 517B

The cyclopentene 516 (5 g, 0.02164 mol) was dissolved in a solution of 220 mL acetone and water (10:1) in a single neck 500 mL RBF and to it was added N-methyl morpholine-N-oxide (7.6 g, 0.06492 mol) followed by 4.2 mL of 7.6% solution of OsO4 (0.275 g, 0.00108 mol) in tert-butanol at room temperature. After completion of the reaction (~3 h), the mixture was quenched with addition of solid Na2SO3 and resulting mixture was stirred for 1.5 h at room temperature. Reaction mixture was diluted with DCM (300 mL) and washed with water (2×100 mL) followed by saturated NaHCO3 (1×50 mL) solution, water (1×30 mL) and finally with brine (1×50 mL). Organic phase was dried over an Na2SO4 and solvent was removed in vacuum. Silica gel column chromatographic purification of the crude material was afforded a mixture of diastereomers, which were separated by prep HPLC. Yield: ~6 g crude 517A—Peak-1 (white solid), 5.13 g (96%). 1H-NMR (DMSO, 400 MHz): δ=7.39-7.31 (m, 5H), 5.04 (s, 2H), 4.78-4.73 (m, 1H), 4.48-4.47 (d, 2H), 3.94-3.93 (m, 2H), 2.71 (s, 3H), 1.72-1.67 (m, 4H). LC-MS—[M+H]−266.3, [M+NH4+] −283.5 present, HPLC-97.86%. Stereochemistry confirmed by X-ray.

Synthesis of 518

Using a procedure analogous to that described for the synthesis of compound 505, compound 518 (1.2 g, 41%) was obtained as a colorless oil. 1H-NMR (CDCl3, 400 MHz): δ=7.35-7.33 (m, 4H), 7.30-7.27 (m, 1H), 5.37-5.27 (m, 8H), 5.12 (s, 2H), 4.75 (m, 1H), 4.58-4.57 (m, 2H), 2.78-2.74 (m, 7H), 2.06-2.00 (m, 8H), 1.96-1.91 (m, 2H), 1.62 (m, 4H), 1.48 (m, 2H), 1.37-1.25 (br m, 36H), 0.87 (m, 6H). HPLC-98.65%.

General Procedure for the Synthesis of Compound 519

A solution of compound 518 (1 eq) in hexane (15 mL) was added in a drop-wise fashion to an ice-cold solution of LAH in THF (1 M, 2 eq). After complete addition, the mixture was heated at 40° C. over 0.5 h then cooled again on an ice bath. The mixture was carefully hydrolyzed with saturated aqueous Na2SO4 then filtered through celite and reduced to an oil. Column chromatography provided the pure 519 (1.3 g, 68%) which was obtained as a colorless oil. 13C NMR □=130.2, 130.1 (x2), 127.9 (x3), 112.3, 79.3, 64.4, 44.7, 38.3, 35.4, 31.5, 29.9 (x2), 29.7, 29.6 (x2), 29.5 (x3), 29.3 (x2), 27.2 (x3), 25.6, 24.5, 23.3, 226, 14.1; Electrospray MS (+ve): Molecular weight for C44H80NO2 (M+H)+ Calc. 654.6. Found 654.6.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total dsRNA concentration in the formulation, as well as the entrapped fraction, is estimated using a dye exclusion assay. A sample of the formulated dsRNA can be incubated with an RNA-binding dye, such as Ribogreen (Molecular Probes) in the presence or absence of a formulation disrupting surfactant, e.g., 0.5% Triton-X100. The total dsRNA in the formulation can be determined by the signal from the sample containing the surfactant, relative to a standard curve. The entrapped fraction is determined by subtracting the "free" dsRNA content (as measured by the signal in the absence of surfactant) from the total dsRNA content. Percent entrapped dsRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

Additional Formulations
Emulsions

The compositions of the present invention can be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials is also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191, 105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants:

In connection with the present invention, surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Fatty Acids:

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile Salts.

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agent.

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, Mass., 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-Chelating Non-Surfactants:

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of iRNAs at the cellular level can also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293Fectin™ (Invitrogen; Carlsbad, Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™2000 CD (Invitrogen; Carlsbad, Calif.), Lipofectamine™ (Invitrogen; Carlsbad, Calif.), RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPass$^a$ D1 Transfection Reagent (New England Biolabs; Ipswich, Mass., USA), LyoVec™/LipoGen™ (Invivogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents can be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances that increase the viscosity of the suspension including, for example, sodium carboxymethylcellulose, sorbitol and/or dextran. The suspension can also contain stabilizers.

In some embodiments, pharmaceutical compositions featured in the invention include (a) one or more iRNA compounds and (b) one or more other agents which function by a non-RNAi mechanism. Examples of such other agents include but are not limited one or more recombinant cytokines (e.g., IL6, IFN-γ, and TNF), PPAR gamma ligands, and corticosteroids. Basically, the other non-RNAi agents are targeted at the underlying causes of the liver fibrosis and/or aimed at alleviating the symptoms of the condition. Therapeutics for the underlying causes of liver fibrosis are known in the art. Some of such therapeutics and strategies are shown in Table 2.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds that exhibit high therapeutic indices are preferred.

The data obtained from cell culture assays and animal studies can be used in formulating a range of dosage for use in humans. The dosage of compositions featured herein lies generally within a range of circulating concentrations that include the $ED_{50}$ with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured herein can be administered in combination with other known agents effective in treatment of hepatic fibrosis mediated by COL1A1 overexpression. In any event, the administering physician can adjust the amount and timing of iRNA administration on the basis of results observed using standard measures of efficacy known in the art or described herein.

IV. The iRNA Target Genes: COL1A1, TGFβ, and SMAD2/3

The *Homo sapiens* collagen, type I, alpha 1 (COL1A1) is also known as collagen alpha-1(I) chain; alpha-1 type I collagen; pro-alpha-1 collagen type 1; collagen alpha 1 chain type I; collagen of skin, tendon and bone, alpha-1 chain; OI4; and COL1A1.

The COL1A1 gene encodes the pro-alpha1 chains of type I collagen whose triple helix comprises two alpha1 chains and one alpha2 chain. Type I collagen is a fibril-forming collagen found in most connective tissues and is abundant in bone, cornea, dermis and tendon. Mutations in this gene are associated with osteogenesis imperfecta types I-IV, Ehlers-Danlos syndrome type VIIA, Ehlers-Danlos syndrome Classical type, Caffey Disease and idiopathic osteoporosis. Reciprocal translocations between chromosomes 17 and 22, where this gene and the gene for platelet-derived growth factor beta are located, are associated with a particular type of skin tumor called dermatofibrosarcoma protuberans, resulting from unregulated expression of the growth factor. Two transcripts, resulting from the use of alternate polyadenylation signals, have been identified for this gene. The human COL1A1 gene is conserved in chimpanzee, dog, cow, mouse, rat, and zebrafish.

The GENBANK™ Accession No. for the human COL1A1 mRNA is NM_000088.3 and the sequence is provided herein as SEQ ID NO: 172.

The GENBANK™ Accession No. for the mouse COL1A1 mRNA is NM_007742.3 and the sequence is provided herein as SEQ ID NO: 173.

The Homo sapiens transforming growth factor, beta 1 (TGFβ1) is also known as TGF-beta-1, TGF-beta 1 protein, latency-associated peptide, CED, LAP, DPD1, TGFb and TGFbeta. This gene encodes a member of the transforming growth factor beta (TGFβ) family of cytokines, which are multifunctional peptides that regulate proliferation, differentiation, adhesion, migration, and other functions in many cell types. Many cells have TGFβ receptors, and the protein positively and negatively regulates many other growth factors. The secreted protein is cleaved into a latency-associated peptide (LAP) and a mature TGFβ1 peptide, and is found in either a latent form composed of a TGFβ1 homodimer, a LAP homodimer, and a latent TGFβ1-binding protein, or in an active form composed of a TGFβ1 homodimer. The mature peptide can also form heterodimers with other TGFβ family members. The human TGFβ1 gene is conserved in chimpanzee, dog, mouse, rat, and zebrafish.

The GENBANK™ Accession No. for the human TGFβ1 mRNA is 1.NM_000660.4 and the sequence is provided herein as SEQ ID NO: 174.

The Genbank™ Accession No. for the mouse TGFβ1 mRNA is 1.NM_011577.1; GI:6755774 and the sequence is provided herein as SEQ ID NO: 175.

The Homo sapiens SMAD family member 2 (SMAD2) is also known as "mothers against decapentaplegic homolog 2", MAD homolog 2, Mad protein homolog, Mad-related protein 2, mother against DPP homolog 2, mothers against DPP homolog 2, Sma- and Mad-related protein 2, JV18; MADH2; MADR2; JV18-1; hMAD-2; hSMAD2; MGC22139; MGC34440; and SMAD2. SMAD proteins are signal transducers and transcriptional modulators that mediate multiple signaling pathways. SMAD2 is recruited to the TGF-beta receptors through its interaction with the SMAD anchor for receptor activation (SARA) protein. In response to TGF-beta signal, SMAD2 is phosphorylated by the TGF-beta receptors. The phosphorylation induces the dissociation of this protein with SARA and the association with the family member SMAD4. The association with SMAD4 is important for the translocation of this protein into the nucleus, where it binds to target promoters and forms a transcription repressor complex with other cofactors. SMAD2 can also be phosphorylated by activin type 1 receptor kinase, and mediates the signal from the activin. Alternatively spliced transcript variants encoding the same protein have been observed. The human SMAD2 gene is conserved in chimpanzee, dog, cow, mouse, rat, chicken, and zebrafish.

There are three known isoforms of the human SMAD2 transcripts. The GENBANK™ Accession Nos. for these three human SMAD2 mRNAs are NM_001003652.2, NM_001135937.1 and NM_005901.4 and the sequences are provided herein as SEQ ID NO: 176, SEQ ID NO: 177, and SEQ ID NO: 178, respectively.

There is one known transcript for the mouse SMAD2. The GENBANK™ Accession Nos. for the mouse SMAD2 mRNAs is NM_010754.4 and the sequence is provided herein as SEQ ID NO: 179.

The Homo sapiens SMAD family member 3 (SMAD3) is also known as "mothers against decapentaplegic homolog 3", MADH3, hMAD-3, hSMAD3, MAD homolog 3, mad protein homolog, mothers against DPP homolog 3, SMA- and MAD-related protein 3, mad homolog JV15-2, HSPC193, HsT17436, MGC60396, DKFZp586N0721, and DKFZp686J10186.

The protein encoded by this gene belongs to the SMAD, a family of proteins similar to the gene products of the Drosophila gene 'mothers against decapentaplegic' (Mad) and the C. elegans gene Sma. SMAD3 mediates the signal of the transforming growth factor (TGF)-beta, and thus regulates multiple cellular processes, such as cell proliferation, apoptosis, and differentiation. SMAD3 functions as a transcriptional modulator activated by transforming growth factor-beta and is thought to play a role in the regulation of carcinogenesis. The human SMAD3 gene is conserved in chimpanzee, dog, cow, mouse, rat, chicken, zebrafish, fruit fly, and mosquito.

There are at least four isoforms of the SMAD3 transcripts. The GENBANK™ Accession Nos. for the four human SMAD3 mRNAs are NM_001145102.1, NM_001145103.1, NM_001145104.1, and NM_005902.3 and the sequences are provided herein as SEQ ID NO: 180, SEQ ID NO: 181, SEQ ID NO: 182, and SEQ ID NO: 183, respectively.

There is one known transcript for the mouse SMAD3. The GENBANK™ Accession Nos. for the mouse SMAD3 mRNAs is NM_016769.4 and the sequence is provided herein as SEQ ID NO: 184.

V. The Liver, Liver Disease, Fibrobsis and Cirrhosis

Fibrosis is characterized by the formation of an abnormal amount of fibrous connective tissue in an organ or part as the result of inflammation, irritation, or healing. Fibrotic disorders, include, but are not limited to, systemic sclerosis (SSc), idiopathic pulmonary fibrosis (IPF), interstitial lung disease (ILD), cirrhosis of the liver, nephrogenic systemic fibrosis (NSF), pneumoconiosis (chronic respiratory disease caused by inhaling metallic or mineral particles), fasciitis, scleromyxedema, retroperitoneal fibrosis, pulmonary fibrosis, liver fibrosis, chronic graft versus host disease and chronic allograft rejection and cystic fibrosis, are characterized by abnormal and excessive deposition of collagen and other extracellular matrix (ECM) components in various tissues. Active fibrosis also can occur in rheumatoid arthritis, lupus, autoimmune diseases, Lyme disease, asthma, idiopathic pulmonary fibrosis, chronic pulmonary fibrosis, uterine fibrosis, and ovarian fibrosis. Although their etiology is quite diverse, the presence of ECM-producing fibroblasts displaying an activated phenotype in the affected tissues is typical of all fibrotic diseases. Fibroblast activation is characterized by a marked increase in the transcriptional activity of the genes encoding type I and type III collagens and fibronectin, initiation of the expression of alpha-smooth muscle actin (α-SMA), and the reduction of ECM degradative activities. Activated fibroblasts display contractile properties resulting from the expression of stress fibers containing α-SMA, and their pro-fibrotic activation is part of a complex set of molecular and biochemical changes that are conserved for multiple sequential passages in vitro.

In the body, the liver is the most complex and metabolically active organ and it performs over 500 vital functions. It is also the major detoxification organ in the body. The liver regulates most chemical levels in the blood and secretes bile, which helps carry away waste products from the liver. All the blood leaving the stomach and intestines passes through the liver. The liver processes this blood and breaks down the nutrients and other components into forms that are become available for use for the rest of the body. Some of the important functions are as follows: (1) provides immunity against infection; (2) manufactures most of the important proteins in the body, and also cholesterol and lipoproteins in which all body fats are carried; (3) clears the blood of most chemicals, drugs and alcohol; (4) excretes bile into the intestine. Bile is vital for digestion of fats, and also serves to carry body wastes; (5) regulates clotting of blood by manufacturing vital proteins; and (6) converts and stores extra sugar (glucose) in the form of starch (glycogen) which can be used in times of starvation. In addition, the liver has an enormous reserve function capacity. All liver functions remain normal even if 70% of it is removed. The liver is also the only organ in the body which can regenerate itself after large portions of it are removed.

Fibrosis of the liver occurs when an abnormal amount of fibrous connective tissue is produced as the result of inflammation, irritation, or healing caused by an underlying acute or chronic liver condition. Hepatitis is an inflammation of the liver that results in liver cell damage and destruction. Hepatitis can be acute, i.e., acute liver disease, or chronic, i.e., chronic liver disease. Patients who do not recover fully from acute hepatitis can develop chronic hepatitis, as the liver continues to sustain more damage and inflammation. Hepatitis is considered chronic if symptoms persist longer than three months to six months. Inflammation/irritation/healing in a chronic liver condition can be due to a viral (e.g. hepatitis A, B, C, D, E or G) or other infection (*Entamoeba histolytica*, malaria parasite *Plasmodium* sp., roundworm *Trichinella spiralis*, the Chinese liver fluke, *Clonorchis sinensis*, and fluke of the genus *Schistosoma*); autoimmune hepatitis; bile duct obstruction or billiary diseases due to biliary atresia, a congenital disorder, primary biliary cirrhosis (PBC), and primary sclerosing cholangitis (PSC); metabolic disorders (e.g., hemochromatosis—too much iron; Wilson's Disease—too much copper), fat accumulation due to alcohol abuse or the idiopathic non-NASH, which is often associated with diabetes and obesity; and exposure to toxic chemicals, e.g., overdose of drugs such as acetaminophen, paracetamol, dry cleaning chemicals, and some wild mushrooms; and liver cancer. Approximately 90 percent of patients who develop liver tumors suffer from cirrhosis. Types of liver cancer include: hepatocellular carcinoma, fibrolamellar carcinoma, secondary liver cancer, and cholangiocarcinoma (bile duct tumor). Other causes of liver fibrosis include obstruction of outflow of blood from the liver (i.e., Budd-Chiari syndrome), Crigler-Najjar syndrome, Gilbert syndrome, Dubin-Johnson syndrome, hyperbilirubinemia, heart and blood vessel disturbances, alpha1-antitrypsin deficiency, high blood galactose levels, high blood tyrosine levels at birth, glycogen storage disease, diabetes and malnutrition.

The process that initiates the progression towards chronic liver disease and fibrosis of the liver starts with an acute hepatitis. If acute hepatitis is not resolved, chronic hepatitis occurs and sets the stage for chronic liver disease characterized by fibrosis, and in some cases, cirrhosis. As an illustration, alcohol-induced liver disease caused by excessive consumption of alcohol starts with the fatty liver (Stage I). Fatty liver is excessive accumulation of fat inside the liver cells. This is the most common alcohol-induced liver disorder. The liver is enlarged, causing upper abdominal discomfort on the right side. In stage II, alcoholic hepatitis occurs which is an acute inflammation of the liver, accompanied by the destruction of individual liver cells and scarring. Symptoms can include fever, jaundice, an increased white blood cell count, an enlarged, tender liver, and spider-like veins in the skin. Stage III is alcoholic cirrhosis, characterized by the destruction of normal liver tissue, leaving non-functioning scar tissue. Symptoms can include those of alcoholic hepatitis, in addition to portal hypertension (leading to blood vomiting), enlarged spleen, ascites, excessive bleeding (due to poor clotting), kidney failure, confusion, or liver cancer.

Cirrhosis of the liver is a chronic disease of the liver characterized by the replacement of normal tissue with fibrous tissue and the loss of functional liver cells. The general architecture of liver cirrhosis is regenerative nodules surrounded by dense fibrotic tissue. The overgrowth of fibrosis scar tissue inhibits the liver's proper functioning. Liver fibrosis usually results in cirrhosis and is a late stage of hepatic fibrosis that has resulted in widespread distortion of normal hepatic architecture. The causes of cirrhosis are the same as those of fibrosis. Cirrhosis is usually considered irreversible. This irreversible scarring of the liver can be life-threatening. In an advanced stage, 80-90% liver can be damaged and replaced with scar tissue. Symptoms of cirrhosis vary, depending on severity. Mild cirrhosis can not exhibit any symptoms at all. Initial symptoms of liver cirrhosis can include general symptoms such as tiredness, lethargy, yellowness of eyes and urine (mild jaundice), swollen feet, excessive itching and anemia (low hemoglobin). In more advanced stages, the patient can have severe life threatening complications such as blood vomiting, bloated stomach due to water (ascites) in the abdomen which can develop serious infection, mental deterioration and coma, deep jaundice and kidney impairment. In addition, the patient can have a bleeding tendency due to low levels of the liver protein prothrombin, and low platelet count both of which are vital for normal clotting of blood.

Fibrosis and cirrhosis of the liver can be assessed and diagnosed by medical procedures known to one skilled in the art. The medical procedures include but are not limited to specific laboratory tests, liver function tests, liver biopsy, Doppler ultrasonography, CT and/or MR imaging and cholangiography α-rays of the bile ducts).

Specific laboratory tests, liver and function tests include non-invasive diagnostic procedures comprising a series of blood tests which can often determine whether or not the liver is functioning properly. These tests can also distinguish between acute and chronic liver disorders and between hepatitis and cholestasis. The most commonly performed blood tests include: (1) serum bilirubin test—elevated levels of bilirubin often indicate an obstruction of bile flow or a defect in the processing of bile by the liver-bilirubin is produced by the liver and is excreted in the bile; (2) serum albumin test—below-normal levels of albumin, are associated with many chronic liver disorders; (3) serum alkaline phosphatase test—elevated levels of alkaline phosphatase, an enzyme found in the bile, usually indicate an obstruction of bile flow, liver injury, or certain cancers; (4) serum aminotransferases (transaminases)—this enzyme is released from damaged liver cells; (5) prothrombin time (PTT) test—this test measures the time it takes for blood to clot. Blood clotting requires vitamin K and a protein made by the liver. Liver cell damage and bile flow obstruction can both interfere with proper blood clotting; (7) alanine transaminase (ALT) test—this enzyme is released from damaged liver cells; (8) aspartate transaminase (AST) test—this enzyme is released from damaged liver, heart, muscle, or brain cells; (9) gamma-glutamyl transpeptidase test—this enzyme is produced by the liver, pancreas, and kidneys and released into the blood when these organs are injured; (10)

lactic dehydrogenase test—this enzyme is released when organs such as the liver, heart, lung, or brain are injured; (11) 5-nucleotidase test—this enzyme is released by the liver when the liver is injured due to bile duct obstruction or impaired bile flow; (12) alpha-fetoprotein test—this protein is produced by the fetal liver and testes, indicating hepatitis or cancer when hepatisits is experienced in adults; (13) mitochondrial antibodies test—the presence of these antibodies can indicate primary biliary cirrhosis, chronic active hepatitis, and certain other autoimmune disorders. In some embodiments, biomarkers of fibrosis are used to assess and diagnose liver fibrosis and/or cirrhosis. Biomarkers of liver fibrosis are known in the art, for example, see Table 9. Test results may be normal or may detect nonspecific abnormalities due to complications of cirrhosis or alcoholism. ALT and AST levels are often modestly elevated. Alkaline phosphatase and γ-glutamyl transpeptidase (GGT) are often normal; elevated levels indicate cholestasis or biliary obstruction. Bilirubin is usually normal but increases when cirrhosis progresses, particularly in primary biliary cirrhosis (see below). Decreased serum albumin and a prolonged PT directly reflect impaired hepatic synthesis—usually an end-stage event. Albumin can also be low when nutrition is poor. Serum globulin increases in cirrhosis and in most liver disorders with an inflammatory component. Anemia is common and usually normocytic with a high RBC distribution width. Anemia is often multifactorial: microcytic from chronic GI bleeding; macrocytic from folate nutritional deficiency or hemolysis (especially in alcohol abuse) and hypersplenism. CBC can also detect leucopenia, thrombocytopenia, or pancytopenia.

Liver biopsy is currently considered the gold standard for the accurate diagnosis of liver fibrosis and cirrhosis, or for ruling out any coexisting liver disease, staging and grading the severity of liver disease, treatment decisions, patient and provider reassurance, and as a benchmark for gauging future disease progression. A diagnosis biopsy is a very important and helpful test in the diagnosis of numerous diseases that affect the liver and bile ducts. In most cases, this allows establishment of a very specific diagnosis and also permit staging and grading of the condition. Several staging and grading scales are known to in the art, for example, see Table 8 (F. Grtinhage and F. Lammert, Chapter 20: Assessment of hepatic fibrosis in chronic viral hepatitis, in Hepatology: a clinical textbook. Eds. Mauss, Berg, Rockstroh, Sarrazin and Wedemeyer, 2nd ed. 2010) and the Child-Turcotte-Pugh Scoring System (Merck Medical Manuals). A monitoring liver biopsy can help the doctor monitor the effectiveness of therapy that the patient is receiving for a disease that affects the liver. There are many different types of liver biopsies, such as the percutaneous (via a needle through the skin), transjugular (through the blood vessels), laparoscopic (via small abdomen incisions), fine needle aspiration and open surgery liver biopsy. During the procedure, small pieces of liver tissue are removed in order to be sent to a laboratory for histological examination.

Other non-invasive techniques for diagnosis and staging liver fibrosis are also used. For example, liver fibrosis markers: α-2-macroglobulin (α-MA), transferrin, apolipoproteinA1, hyaluronic acid (HA), laminin, N-terminal procollagen III(PIIINP), 7S collagen IV (7S-IV), total bilirubin, indirect bilirubin, alanine aminotransferase (ALT), aspartate aminotransferase (AST), AST/ALT, g-glutamyl transpeptidase (GGT), alkaline phosphatase (ALP), albumin, albumin/globulin, blood urea nitrogen (BUN), creatinine (Cr), triglyceride, cholesterol, and high density lipoprotein and low density lipoprotein. Lun-Gen Lu et al. (World J. Gastroenteroloygy, 2003, 9(11):2574-2578) measured over 20 non-invasive parameters of 200 patients with chronic liver disease and attempted to correlate inflammatory activity, as determined by the levels of the non-invasive parameters, with fibrosis of consecutive liver biopsies from these patients in order to stage and grade liver fibrosis without having to perform the gold standard liver biopsy. In pathological diagnosis, Stage 1 and Stage 2 indicated mild fibrosis, Stage 3 and Stage 4 indicated severe fibrosis. Lun-Gen Lu et al. found that there was a close correlation between liver fibrosis and inflammatory activity. AST, GGT, albumin, albumin/globulin, ALP, AFP, hyaluronic acid, N-terminal procollagen III (P III NP), collagen type IV (Col IV), tissue inhibitors of metalloproteinases-1(TIMP-1), alpha-2-macroglobulin, natural killer cells (NK), some parameters of Doppler ultrasonography, CT and/or MR imaging were all related to the degree of inflammatory activity. GGT, albumin, albumin/globulin, ALP, AFP, hyaluronic acid, Col IV, TIMP-1, alpha-2-macroglobulin, transforming growth factor-beta 1(TGFb1), NK, some parameters of Doppler ultrasonography, CT and/or MR imaging were all related to the staging of fibrosis. It was found that the level of TGFβ and TIMP-1 increased more significantly in inflammation and early stage of fibrosis, indicating that they could reflect the changes of liver inflammation and fibrosis. GGT, albumin, albumin/globulin, ALP, AFP, HA, 7S-IV, and α2-MA had a positive correlation with liver fibrosis. In this study, PIIINP, laminin, transferrin, and apoproteinA1 which were known to have significant diagnostic value, were not confirmed.

Treatment of liver disease and consequent liver fibrosis includes, but is not limited to, treating the primary cause of the inflammation or irritation in the liver and controlling the inflammation (see Table 2). In addition to the dsRNA-mediated approaches described herein, treatment can also include one/more of the following: Antiviral Agents—when liver disease or liver fibrosis is caused by hepatitis B or C, inflammation of the liver can be stopped with the injectable antiviral drug interferon-alpha. In addition, in Hepatitis B, oral anti-viral agents such as lamivudine or adefovir can be used, while in Hepatitis C, ribavirin can be used. Corticosteroids—corticosteroids can be used to treat chronic liver disease caused by an autoimmune disorder. However, even when inflammation is suppressed, it is possible that scarring of the liver may continue. Discontinuation of certain drugs—when chronic hepatitis is caused by certain drugs, discontinuing those drugs usually clears up any symptoms. Discontinuance of alcohol—while this is essential for recovery in alcohol induced chronic liver disease, it is also highly advisable in Hepatitis C and other chronic diseases of the liver. Examples of other therapies include those disclosed in Table 2. In addition, traditional Chinese medicine such as Qinggan Capsule, ginkgo leaf, Ruangan, salvia, bupleurum and white peony can be used in combination with the therapeutic methods and compositions for the treatment, prevention and/or management of liver fibrosis.

VI. Methods for Inhibiting Expression of a COL1A1, TGFβ, and/or SMAD2/3 Gene In one aspect, provided herein is a method of inhibiting COL1A1 expression in a cell, the method comprising: (a) introducing into the cell a dsRNA that targets a COL1A1, TGFβ or SMAD2/3 gene in the cell; and (b) maintaining the cell produced in step (a) for a time sufficient to obtain degradation of the mRNA transcript of a COL1A1, TGFβ or SMAD2/3 gene respectively, thereby inhibiting expression of the COL1A1 gene in the cell. In the embodiments where the dsRNA targets TGFβ and/or SMAD2/3 gene expression, the expression of the COL1A1 gene in the cell is indirectly inhibited by way of reduced signaling from TGFβ which stimulates the cell to overexpress COL1A1. The inhibition is not by way of degradation of the mRNA transcript of the COL1A1 gene. Reduction in gene expression can be assessed by any methods known it the art and by methods, e.g. qRT-PCR, described herein.

In one embodiment, the cell is a mammalian cell, preferably a human cell. In another embodiment, the cell is a mammalian liver cell. In a preferred embodiment, the cell is a HSC.

In one embodiment, more than one dsRNA is introduced into the cell. In one embodiment, the dsRNAs targeting COL1A1, TGFβ and/or SMAD2/3 gene are introduced to the cell, i.e. a combination of dsRNA are introduced into the cell and more that one gene is targeted. For example, a combination of COL1A1iRNA and TGFβiRNA, a combination of COL1A1iRNA and SMAD2/3iRNA or a combination of COL1A1iRNA, TGFβiRNA and SMAD2/3iRNA.

In one embodiment, the dsRNA is introduced to the cell, preferably, in a liposome, e.g. a LNP-formulated liposome known in the art and/or described herein. In one embodiment, the LNP is formulated to target a specific cell such as a HSC. For example, the LNP-formulated liposome can be coupled to Vitamin A in order to target the LNP-encapsulated dsRNA to the vitamin A-sequestering HSC.

In one embodiment, the COL1A1 expression is inhibited by at least, 10%, 20%, 30%, 40%, 50%, 60%, 70%, 80%, 90%, 95%, or even 100%. In the embodiments where TGFβ and/or SMAD2/3 genes expression are also inhibited by dsRNAs, their respectively expressions are inhibited by at least 30%, in addition to a decrease in COL1A1 expression.

In one aspect, provided herein is a method for inhibiting the expression of a COL1A1 gene in a mammal, the method comprising (a) administering to the mammal a composition comprising a dsRNA that targets a COL1A1, TGFβ, or SMAD2/3 gene in a cell of the mammal; and (b) maintaining the mammal of step (a) for a time sufficient to obtain degradation of the mRNA transcript of a COL1A1, TGFβ, or SMAD2/3 gene respectively, thereby inhibiting expression of the COL1A1 gene in the cell. In the embodiments where the dsRNA targets TGFβ and/or SMAD2/3 gene expression, the expression of COL1A1 in the cell is indirectly inhibited by way of reduced signaling from TGFβ which stimulates the cell to overexpress COL1A1; the inhibition is not by way of degradation of the mRNA transcript of the COL1A1 gene. Reduction in gene expression can be assessed by any methods known it the art and by methods, e.g. qRT-PCR, described herein. In one embodiment, a puncture liver biopsy sample serves as the tissue material for monitoring the reduction in the target gene expression.

In one embodiment, the method includes administering a composition featured herein to the mammal such that expression of the target COL1A1 gene is decreased, such as for an extended duration, e.g., at least two, three, four days or more, e.g., one week, two weeks, three weeks, or four weeks or longer.

Preferably, the iRNAs useful for the methods and compositions featured herein specifically target RNAs (primary or processed) of the target COL1A1, TGFβ, or SMAD2/3 gene. Compositions and methods for inhibiting the expression of these genes using iRNAs can be prepared and performed as described elsewhere herein.

In some embodiments of the aspects described herein, the methods and compositions featured herein comprise more than one iRNA such that more than one iRNA is administered to the mammal and more than one gene is targeted in the mammal. For example, a combination of COL1A1iRNA and TGFβiRNA, a combination of COL1A1iRNA and SMAD2/3iRNA or a combination of COL1A1iRNA, TGFβiRNA and SMAD2/3iRNA.

Accordingly, in some embodiments of the aspects described herein, the methods and the composition described herein comprises iRNAs targeting a COL1A1 gene and a TGFβ gene. In these methods, both the COL1A1 and TGFβ gene expressions are inhibited. In another embodiment, the methods and the composition described herein comprises iRNAs targeting a COL1A1 gene and a SMAD2/3 gene. In these methods, both the COL1A1 and SMAD2/3 gene expressions are inhibited. In yet another embodiment, the methods and the composition described herein comprises iRNAs targeting a COL1A1 gene, a TGFβ gene and a SMAD2/3 gene. In these methods, all three the COL1A1, SMAD2/3 and TGFβ gene expressions are inhibited.

In one embodiment of the aspects described herein, the method includes administering a composition containing an iRNA, where the iRNA includes a nucleotide sequence that is complementary to at least a part of an RNA transcript of the COL1A1, TGFβ, or SMAD2/3 gene of the mammal to be treated. When the organism to be treated is a mammal such as a human, the composition can be administered by any means known in the art including, but not limited to oral, intraperitoneal, or parenteral routes, including intracranial (e.g., intraventricular, intraparenchymal and intrathecal), intravenous, intramuscular, subcutaneous, transdermal, airway (aerosol), nasal, rectal, and topical (including buccal and sublingual) administration. In certain embodiments, the compositions are administered by intravenous infusion or injection.

VII. Methods for Treating Liver Disease and Liver Fibrosis Characterized by the Overexpression of a COL1A1 Gene Aspects and embodiments of the invention relate in particular to the use of an iRNA targeting COL1A1 gene expression and compositions containing at least one iRNA for the treatment of a COL1A1-mediated liver fibrosis. Embodiments of the invention also relate to the use of an iRNA targeting the molecules in the signaling pathway that promote COL1A1 gene expression, e.g. TFGβ and SMAD2/3. For example, a composition containing an iRNA targeting a COL1A1 gene is used for treating and/or preventing liver fibrosis or a composition containing an iRNA targeting a TGFβ and/or SMAD2/3 gene is used for treating and/or preventing liver fibrosis In one embodiment, provided herein is a method of treating and/or preventing hepatic fibrosis in a subject in need of such treatment, the method comprising administering to the subject a therapeutically effective amount of the iRNA that targets a COL1A1, TGFβ, or SMAD2/3 gene.

In one embodiment, the method of treating and/or preventing hepatic fibrosis comprises (a) administering to the subject a composition comprising a iRNA that targets a COL1A1, TGFβ, or SMAD2/3 gene in a cell of the mammal; and (b) maintaining the subject of step (a) for a time sufficient to obtain degradation of the mRNA transcript of a COL1A1, TGFβ, or SMAD2/3 gene respectively, thereby inhibiting or reducing expression of the COL1A1 gene in the cell. In the embodiments where the iRNA targets TGFβ and/or SMAD2/3 gene expression, the expression of COL1A1 in the cell is indirectly reduced by way of reduced signaling from TGFβ which stimulates the cell to over express COL1A1; the reduction of COL1A1 expression is not by way of degradation of the mRNA transcript of the COL1A1 gene. Reduction in gene expression can be assessed by any methods known it the art and by methods, e.g. qRT-PCR, described herein. In one embodiment, a puncture liver biopsy sample serves as the tissue material for monitoring the reduction in the target gene expression.

In one embodiment, the liver fibrosis is a result of a viral or other infection, an autoimmune disorder, a bile duct obstruction, metabolic disorders, alcoholic abuse, primary biliary cirrhosis, NASH, exposure to chemicals or cancer. In other embodiments, the liver fibrosis is the results of other indications described herein.

In one embodiment, more than one dsRNA is administered to the subject, and as a result thereof, more than one gene is targeted. For example, a combination of COL1A1 iRNA and TGFβ iRNA, a combination of COL1A1 iRNA and SMAD2/3 iRNA or a combination of COL1A1 iRNA, TGFβ iRNA and SMAD2/3 iRNA.

In one embodiment, the method of treating and/or preventing hepatic fibrosis described herein comprises iRNAs targeting a COL1A1 gene and a TGFβ gene. In this embodiment, both the COL1A1 and TGFβ gene expressions are inhibited. In another embodiment, the method of treating and/or preventing hepatic fibrosis described herein comprises iRNAs targeting a COL1A1 gene and a SMAD2/3 gene. In this embodiment, both the COL1A1 and SMAD2/3 gene expression are inhibited. In yet another embodiment, the method of treating and/or preventing hepatic fibrosis described herein comprises iRNAs targeting a COL1A1 gene, a TGFβ gene and a SMAD2/3 gene. In this embodiment, all three of the COL1A1, SMAD2/3 and TGFβ gene expressions are inhibited.

In one embodiment, iRNAs targeting a COL1A1 gene, a TGFβ gene, and a SMAD2/3 gene are administered.

In one embodiment, the iRNA is administered at a concentration of 0.01 mg/kg-5 mg/kg bodyweight of the subject.

In one embodiment, the method further relates to the use of an iRNA or a pharmaceutical composition thereof, e.g., for treating and/or preventing chronic liver disease or hepatic fibrosis, in combination with other pharmaceuticals and/or other therapeutic methods, e.g., with known pharmaceuticals and/or known therapeutic methods, for example, those which are currently employed for treating the underlying causes of the chronic liver disease or hepatic fibrosis. For example, the iRNA or pharmaceutical composition thereof can also be administered in conjunction with one or more additional anti-hepatic cancer treatments, such as biological chemotherapy and radiation. Accordingly, a treatment can include, for example, chemotherapy (for example, chlorambucil, prednisone, prednisolone, vincristine, cytarabine, clofarabine, farnesyl transferase inhibitors, decitabine, inhibitors of MDR1), rituximab, interferon-α, anthracycline drugs (such as daunorubicin or idarubicin), L-asparaginase, doxorubicin, cyclophosphamide, doxorubicin, bleomycin, fludarabine, etoposide, pentostatin, or cladribine), bone marrow transplant, stem cell transplant, anti-metabolite drugs (methotrexate and 6-mercaptopurine), or any combination thereof.

Chemotherapy is the treatment of cancer with drugs that can destroy cancer cells. In current usage, the term "chemotherapy" usually refers to cytotoxic drugs which affect rapidly dividing cells in general, in contrast with targeted therapy. Chemotherapy drugs interfere with cell division in various possible ways, e.g. with the duplication of DNA or the separation of newly formed chromosomes. Most forms of chemotherapy target all rapidly dividing cells and are not specific to cancer cells, although some degree of specificity may come from the inability of many cancer cells to repair DNA damage, while normal cells generally can. Most chemotherapy regimens are given in combination. Exemplary chemotherapeutic agents include, but are not limited to, 5-FU Enhancer, 9-AC, AG2037, AG3340, Aggrecanase Inhibitor, Aminoglutethimide, Amsacrine (m-AMSA), Asparaginase, Azacitidine, Batimastat (BB94), BAY 12-9566, BCH-4556, Bis-Naphtalimide, Busulfan, Capecitabine, Carboplatin, Carmustaine+Polifepr Osan, cdk4/cdk2 inhibitors, Chlorombucil, CI-994, Cisplatin, Cladribine, CS-682, Cytarabine HCl, D2163, Dactinomycin, Daunorubicin HCl, DepoCyt, Dexifosamide, Docetaxel, Dolastain, Doxifluridine, Doxorubicin, DX8951f, E 7070, EGFR, Epirubicin, Erythropoietin, Estramustine phosphate sodium, Etoposide (VP16-213), Farnesyl Transferase Inhibitor, FK 317, Flavopiridol, Floxuridine, Fludarabine, Fluorouracil (5-FU), Flutamide, Fragyline, Gemcitabine, Hexamethylmelamine (HMM), Hydroxyurea (hydroxycarbamide), Ifosfamide, Interferon Alfa-2a, Interferon Alfa-2b, Interleukin-2, Irinotecan, ISI 641, Krestin, Lemonal DP 2202, Leuprolide acetate (LHRH-releasing factor analogue), Levamisole, LiGLA (lithium-gamma linolenate), Lodine Seeds, Lometexol, Lomustine (CCNU), Marimistat, Mechlorethamine HCl (nitrogen mustard), Megestrol acetate, Meglamine GLA, Mercaptopurine, Mesna, Mitoguazone (methyl-GAG; methyl glyoxal bis-guanylhydrazone; MGBG), Mitotane (o.p'-DDD), Mitoxantrone, Mitoxantrone HCl, MMI 270, MMP, MTA/LY 231514, Octreotide, ODN 698, OK-432, Oral Platinum, Oral Taxoid, Paclitaxel (TAXOL.RTM.), PARP Inhibitors, PD 183805, Pentostatin (2' deoxycoformycin), PKC 412, Plicamycin, Procarbazine HCl, PSC 833, Ralitrexed, RAS Farnesyl Transferase Inhibitor, RAS Oncogene Inhibitor, Semustine (methyl-CCNU), Streptozocin, Suramin, Tamoxifen citrate, Taxane Analog, Temozolomide, Teniposide (VM-26), Thioguanine, Thiotepa, Topotecan, Tyrosine Kinase, UFT (Tegafur/Uracil), Valrubicin, Vinblastine sulfate, Vindesine sulfate, VX-710, VX-853, YM 116, ZD 0101, ZD 0473/Anormed, ZD 1839, ZD 9331.

Efficacy of treatment of liver fibrosis or amelioration of liver fibrosis can be assessed, for example by periodic monitoring liver fibrosis markers: α-2-macroglobulin (a-MA), transferrin, apolipoproteinA1, hyaluronic acid (HA), laminin, N-terminal procollagen III (PIIINP), 7S collagen IV (7S-IV), total bilirubin, indirect bilirubin, alanine aminotransferase (ALT), aspartate aminotransferase (AST), AST/ALT, g-glutamyl transpeptidase (GGT), alkaline phosphatase (ALP), albumin, albumin/globulin, blood urea nitrogen (BUN), creatinine (Cr), triglyceride, cholersterol, high density lipoprotein and low density lipoprotein and liver punctuce biopsy. Liver fibrosis markers can be measured and/or liver puncture biopsy can be performed before treatment (initial readings) and subsequently (later readings) during the treatment regimen. Comparisons of the later readings with the initial readings provide a physician indication of whether the treatment is effective. It is well within the ability of one skilled in the art to monitor efficacy of treatment or prevention by measuring any one of such parameters, or any combination of parameters. In connection with the administration of an iRNA targeting COL1A1 or pharmaceutical composition thereof, "effective against" a hepatic fibrosis condition indicates that administration in a clinically appropriate manner results in a beneficial effect for at least a statistically significant fraction of patients, such as a improvement of symptoms, a cure, a reduction in disease load, reduction in tumor mass or cell numbers, extension of life, improvement in quality of life, or other effect generally recognized as positive by medical doctors familiar with treating liver fibrosis and the related causes.

A treatment or preventive effect is evident when there is a statistically significant improvement in one or more parameter markers of hepatic fibrosis status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment, for example, a lower level of liver enzyme activity in the serum or an increase in serum albumin indicating an improvement in liver's ability to synthesize albumin. Efficacy for a given iRNA drug or formulation of that drug can also be judged using an experimental animal model of liver fibrosis as known in the art, e.g. a mouse model described herein. When using an experimental animal model, efficacy of treatment is evidenced when a statistically significant reduction in a marker, symptom or extracellular collagen as viewed histologically is observed.

Infection by viruses and parasites can cause inflammation and hepatic fibrosis. Some examples are the Hepadnaviridae (Hepatitis A and B viruses); Hepatitis D virus, Hepatitis E virus, and unclassified viruses (e.g., the etiological agents of Spongiform encephalopathies, the agent of delta hepatitis (thought to be a defective satellite of hepatitis B virus), the agents of non-A, non-B hepatitis (class 1=enterally transmitted; class 2=parenterally transmitted (i.e., Hepatitis C); Norwalk and related viruses, and astroviruses). Exemplary parasites include, but are not limited to: *Entamoeba histolytica*; the malaria parasite *Plasmodium* species (*Plasmodium falciparum, P. malariae, P. ovale, P. vivax*), the nematode *Trichinella spiralis*, the trematods *Clonorchis sinensis, Schistosoma mansoni, S. haematobium*, and *S. japonicum* and any combination thereof.

In other embodiments, administration of an iRNA targeting COL1A1, TGFβ and/or SMAD2/3 is performed in combination with an anti-viral medicament or agent. Exemplary antiviral agents useful for the methods described herein include, but are not limited to, immunoglobulins, amantadine, interferon, nucleoside analogues, and protease inhibitors. Specific examples of antiviral agents include but are not limited to Acemannan; Acyclovir; Acyclovir Sodium; Adefovir; Alovudine; Alvircept Sudotox; Amantadine Hydrochloride; Aranotin; Arildone; Atevirdine Mesylate; Avridine; Cidofovir; Cipamfylline; Cytarabine Hydrochloride; Delavirdine Mesylate; Desciclovir; Didanosine; Disoxaril; Edoxudine; Enviradene; Enviroxime; Famciclovir; Famotine Hydrochloride; Fiacitabine; Fialuridine; Fosarilate; Foscarnet Sodium; Fosfonet Sodium; Ganciclovir; Ganciclovir Sodium; Idoxuridine; Kethoxal; Lamivudine; Lobucavir; Memotine Hydrochloride; Methisazone; Nevirapine; Penciclovir; Pirodavir; Ribavirin; Rimantadine Hydrochloride; Saquinavir Mesylate; Somantadine Hydrochloride; Sorivudine; Statolon; Stavudine; Tilorone Hydrochloride; Trifluridine; Valacyclovir Hydrochloride; Vidarabine; Vidarabine Phosphate; Vidarabine Sodium Phosphate; Viroxime; Zalcitabine; Zidovudine; and Zinviroxime.

In further embodiments, administration of an iRNA targeting COL1A, TGFβ and/or SMAD2/3 is administered in combination with an anti-parasitic medicament or agent. An "antiparasitic medicament" refers to an agent that kills or inhibits the growth or function of infective parasites. Examples of antiparasitic medicaments, also referred to as parasiticides, useful for the methods described herein include, but are not limited to, albendazole, amphotericin B, benznidazole, bithionol, chloroquine HCl, chloroquine phosphate, clindamycin, dehydroemetine, diethylcarbamazine, diloxanide furoate, doxycycline, eflornithine, furazolidaone, glucocorticoids, halofantrine, iodoquinol, ivermectin, mebendazole, mefloquine, meglumine antimoniate, melarsoprol, metrifonate, metronidazole, niclosamide, nifurtimox, oxamniquine, paromomycin, pentamidine isethionate, piperazine, praziquantel, primaquine phosphate, proguanil, pyrantel pamoate, pyrimethanmine-sulfonamides, pyrimethanmine-sulfadoxine, quinacrine HCl, quinine sulfate, quinidine gluconate, spiramycin, stibogluconate sodium (sodium antimony gluconate), suramin, tetracycline, thiabendazole, timidazole, trimethroprim-sulfamethoxazole, and tryparsamide, some of which are used alone or in combination with others.

The iRNA and an additional therapeutic agent can be administered in combination in the same composition, e.g., parenterally, or the additional therapeutic agent can be administered as part of a separate composition or by another method described herein.

In one embodiment, the iRNA is administered with a non-iRNA therapeutic agent, such as an agent known to treat the underlying cause of the liver disease or hepatic fibrosis, e.g., a viral or other infection, an autoimmune disorder, a bile duct obstruction, metabolic disorders, alcohol abuse, primary biliary cirrhosis, NASH, exposure to chemicals, and liver cancer. Some examples of non-iRNA therapeutics are shown in Table 2. In another embodiment, the iRNA featured described herein, e.g., a dsRNA targeting COL1A1, TGFβ and/or SMAD2/3, is administered along with a non-iRNA therapeutic agent, such as an anti-hepatitis C virus agent. For example, an iRNA featured herein can be administered along with an interferon alpha for treatment of hepatitis C infection.

In one embodiment, the iRNA is COL1A1iRNA and it is administered in combination with a second iRNA targeting a second gene that is involved in signaling pathway leading to the excess deposition of collagen extracellularly in the liver. For example, the second gene can be the gene encoding TGFβ, SMAD2 or SMAD3.

In one embodiment, the iRNA is COL1A1iRNA, TGFβiRNA or SMAD2/3iRNA it is administered in combination with a second iRNA targeting a second gene that is involved in maturation of the pro-collagen produced by the activated HSCs, the collagen-specific chaperone, HSP47.

Patients can be administered a therapeutic amount of iRNA, such as 0.01 mg/kg, 0.05 mg/kg, 0.1 mg/kg, 0.5 mg/kg, 1.0 mg/kg, 1.5 mg/kg, 2.0 mg/kg, or 2.5 mg/kg dsRNA. The iRNA can be administered by intravenous infusion over a period of time, such as over a 5 minute, 10 minute, 15 minute, 20 minute, or 25 minute period. The administration is repeated, for example, on a regular basis, such as biweekly (i.e., every two weeks) for one month, two months, three months, four months or longer. After an initial treatment regimen, the treatments can be administered on a less frequent basis. For example, after administration biweekly for three months, administration can be repeated once per month, for six months or a year or longer. Administration of the iRNA can reduce COL1A1 levels, e.g., in a cell, tissue, e.g. liver tissue or other compartment of the patient by at least 10%, at least 15%, at least 20%, at least 25%, at least 30%, at least 40%, at least 50%, at least 60%, at least 70%, at least 80% or at least 90% or more.

Before administration of a full dose of the iRNA, patients can be administered a smaller dose, such as a 5% infusion reaction, and monitored for adverse effects, such as an allergic reaction, or for elevated lipid levels or blood pressure. In another example, the patient can be monitored for unwanted immunostimulatory effects, such as increased cytokine (e.g., TNF-alpha or IFN-alpha) levels.

Owing to the inhibitory effects on COL1A1 expression, a composition according to the invention or a pharmaceutical composition prepared therefrom can enhance the quality of life and prolong survival in that irreversible liver damage can prevented.

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1: Interference RNA (iRNA) Synthesis

Source of Reagents

Where the source of a reagent is not specifically given herein, such reagent can be obtained from any supplier of reagents for molecular biology at a quality/purity standard for application in molecular biology.

Oligonucleotide Synthesis

Applicants have used several different methods to generate the iRNA molecules described herein. This Example describes one approach that has been used. The ordinarily skilled artisan can use any method known in the art to prepare iRNAs as described herein.

Oligonucleotides are synthesized on an AKTA oligopilot synthesizer. Commercially available controlled pore glass solid support (dT-CPG, 500 Å, Prime Synthesis) and RNA phosphoramidites with standard protecting groups, 5'-O-dimethoxytrityl N6-benzoyl-2'-t-butyldimethylsilyl-adenosine-3'-O—N,N'-diisopropyl-2-cyanoethylphosphoramidite, 5'-O-dimethoxytrityl-N$_4$-acetyl-2'-t-butyldimethylsilyl-cytidine-3'-O-N,N'-diisopropyl-2-cyanoethylphosphoramidite, 5'-O-dimethoxytrityl-N$_2$-isobutryl-2'-t-butyldimethylsilyl-guanosine-3'-O-N,N-diisopropyl-2-cyanoethylphosphoramidite, and 5'-O-dimethoxytrityl-2'-t-butyldimethylsilyl-uridine-3'-O-N,N'-diisopropyl-2-cyanoethylphosphoramidite (Pierce Nucleic Acids Technologies) were used for the oligonucleotide synthesis. The 2'-F phosphoramidites, 5'-O-dimethoxytrityl-N4-acetyl-2'-fluoro-cytidine-3'-O-N,N'-diisopropyl-2-cyanoethyl-phosphoramidite and 5'-O-dimethoxytrityl-2'-fluoro-uridine-3'-O-N,N'-diisopropyl-2-cyanoethyl-phosphoramidite are purchased from (Promega). All phosphoramidites are used at a concentration of 0.2M in acetonitrile ($CH_3CN$) except for guanosine which is used at 0.2M concentration in 10% THF/ANC (v/v). Coupling/recycling time of 16 minutes is used. The activator is 5-ethyl thiotetrazole (0.75M, American International Chemicals); for the PO-oxidation iodine/water/pyridine is used and for the PS-oxidation PADS (2%) in 2,6-lutidine/ACN (1:1 v/v) is used.

3'-ligand conjugated strands are synthesized using solid support containing the corresponding ligand. For example, the introduction of cholesterol unit in the sequence is performed from a hydroxyprolinol-cholesterol phosphoramidite. Cholesterol is tethered to trans-4-hydroxyprolinol via a 6-aminohexanoate linkage to obtain a hydroxyprolinol-cholesterol moiety. 5'-end Cy-3 and Cy-5.5 (fluorophore) labeled iRNAs are synthesized from the corresponding Quasar-570 (Cy-3) phosphoramidite are purchased from Biosearch Technologies. Conjugation of ligands to 5'-end and or internal position is achieved by using appropriately protected ligand-phosphoramidite building block. An extended 15 min coupling of 0.1 M solution of phosphoramidite in anhydrous $CH_3CN$ in the presence of 5-(ethylthio)-1H-tetrazole activator to a solid-support-bound oligonucleotide. Oxidation of the internucleotide phosphite to the phosphate is carried out using standard iodine-water as reported (1) or by treatment with tert-butyl hydroperoxide/acetonitrile/water (10:87:3) with 10 min oxidation wait time conjugated oligonucleotide. Phosphorothioate is introduced by the oxidation of phosphite to phosphorothioate by using a sulfur transfer reagent such as DDTT (purchased from AM Chemicals), PADS and or Beaucage reagent. The cholesterol phosphoramidite is synthesized in house and used at a concentration of 0.1 M in dichloromethane. Coupling time for the cholesterol phosphoramidite is 16 minutes.

Deprotection I (Nucleobase Deprotection)

After completion of synthesis, the support is transferred to a 100 mL glass bottle (VWR). The oligonucleotide is cleaved from the support with simultaneous deprotection of base and phosphate groups with 80 mL of a mixture of ethanolic ammonia [ammonia:ethanol (3:1)] for 6.5 h at 55° C. The bottle is cooled briefly on ice and then the ethanolic ammonia mixture is filtered into a new 250-mL bottle. The CPG is washed with 2×40 mL portions of ethanol/water (1:1 v/v). The volume of the mixture is then reduced to ~30 mL by roto-vap. The mixture is then frozen on dry ice and dried under vacuum on a speed vac.

Deprotection II (Removal of 2'-TBDMS Group)

The dried residue is resuspended in 26 mL of triethylamine, triethylamine trihydrofluoride (TEA.3HF) or pyridine-HF and DMSO (3:4:6) and heated at 60° C. for 90 minutes to remove the tert-butyldimethylsilyl (TBDMS) groups at the 2' position. The reaction is then quenched with 50 mL of 20 mM sodium acetate and the pH is adjusted to 6.5. Oligonucleotide is stored in a freezer until purification.

Analysis

The oligonucleotides are analyzed by high-performance liquid chromatography (HPLC) prior to purification and selection of buffer and column depends on nature of the sequence and or conjugated ligand.

HPLC Purification

The ligand-conjugated oligonucleotides are purified by reverse-phase preparative HPLC. The unconjugated oligonucleotides are purified by anion-exchange HPLC on a TSK gel column packed in house. The buffers are 20 mM sodium phosphate (pH 8.5) in 10% $CH_3CN$ (buffer A) and 20 mM sodium phosphate (pH 8.5) in 10% $CH_3CN$, 1M NaBr (buffer B). Fractions containing full-length oligonucleotides are pooled, desalted, and lyophilized. Approximately 0.15 OD of desalted oligonucleotidess are diluted in water to 150 μL and then pipetted into special vials for CGE and LC/MS analysis. Compounds are then analyzed by LC-ESMS and CGE.

iRNA Preparation

For the general preparation of iRNA, equimolar amounts of sense and antisense strand are heated in 1×PBS at 95° C. for 5 min and slowly cooled to room temperature. Integrity of the duplex is confirmed by HPLC analysis.

Nucleic acid sequences are represented below using standard nomenclature, and specifically the abbreviations of Table 1.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| A | adenosine |
| C | cytidine |
| G | guanosine |
| T | thymidine |
| U | uridine |
| N | any nucleotide (G, A, C, T or U) |
| a | 2'-O-methyladenosine |
| c | 2'-O-methylcytidine |
| g | 2'-O-methylguanosine |
| u | 2'-O-methyluridine |
| dT | 2'-deoxythymidine |
| s | phosphorothioate linkage |

Example 2: COL1A1, TGF, SMAD2/3 siRNAs Design and Synthesis

Transcripts

Oligonucleotide designs were carried out to identify siRNAs targeting the genes encoding the human collagen1A1 molecule (COL1A1), the human transforming growth factor beta 1 (TGFβ), the SMAD family member 2 and 3, and the orthologous sequences from mice (*Mus musculus*) and rat (*Rattus norvegicus*). The design process used the human COL1A1 mRNA NM_000088.3 (SEQ ID NO: 172), the mouse COL1A1 mRNA NM_007742.3 (SEQ ID NO: 173), the human TGFβ mRNA NM_000660.4 (SEQ ID NO: 174), the mouse TGFβ mRNA NM_011577.1 (SEQ ID NO: 175), the four human SMAD3 mRNAs NM_001145102.1 (SEQ ID NO: 180), NM_001145103.1 (SEQ ID NO: 181), NM_001145104.1 (SEQ ID NO: 182), and NM_005902.3 (SEQ ID NO: 183), the mouse SMAD3 mRNAs NM_016769.4 (SEQ ID NO: 184), the three human SMAD2 mRNAs are NM_001003652.2 (SEQ ID NO: 176), NM_001135937.1 (SEQ ID NO: 177), and NM_005901.4 (SEQ ID NO: 178), and the mouse SMAD2 mRNAs is NM_010754.4. All sequences were obtained from the NCBI Refseq collection.

Two sets of oligos were designed: a human-specific set of oligos with 100% identity to human COL1A1, but less than 100% identity in mouse or rat, and a second set of siRNAs with 100% identity to the human, non-human primate, mouse and both rat COL1A1 transcripts. A set of oligos was designed with 100% identity to mouse SMAD2 (NM_010754) and mouse SMAD3 (NM_016769). For TGFβ, the oligo set was designed with 100% identity to human and mouse sequences.

siRNA Design and Specificity Prediction

The specificity of the 19mer oligo sets was predicted from each sequence. The COL1A1, TGFβ AND SMAD2/3 siRNAs were used in a comprehensive search against their respective human, or mouse and rat transcriptomes (defined as NM_ and XM_records within the NCBI Refseq set) using the FASTA algorithm. The Python script 'offtargetFasta.py' was then used to parse the alignments and generate a score based on the position and number of mismatches between the siRNA and any potential 'off-target' transcript. The off-target score is weighted to emphasize differences in the 'seed' region of siRNAs, in positions 2-9 from the 5' end of the molecule. The off-target score is calculated as follows: mismatches between the oligo and the transcript are given penalties. A mismatch in the seed region in positions 2-9 of the oligo is given a penalty of 2.8; mismatches in the putative cleavage sites 10 and 11 are given a penalty of 1.2, and all other mismatches a penalty of 1. The off-target score for each oligo-transcript pair is then calculated by summing the mismatch penalties. The lowest off-target score from all the oligo-transcript pairs is then determined and used in subsequent sorting of oligos. Both siRNAs strands were assigned to a category of specificity according to the calculated scores: a score above 3 qualifies as highly specific, equal to 3 as specific and between 2.2 and 2.8 as moderate specific. In picking which oligos to synthesize, we sorted from high to low by the off-target score of the antisense strand and took the best (lowest off-target score) oligo pairs.

Synthesis of COL1A1, TGFβ and SMAD2/3 RNA Sequences

COL1A1, TGFβ AND SMAD2/3 iRNA sequences were synthesized on a MerMade 192 synthesizer at 11 mol scale.

For all the sequences in the list, 'endolight' chemistry was applied as detailed below.

- All pyrimidines (cytosine and uridine) in the sense strand contained 2'-O-Methyl bases (2' O-Methyl C and 2'-O-Methyl U)
- In the antisense strand, pyrimidines adjacent to (towards 5' position) ribo A nucleoside were replaced with their corresponding 2-O-Methyl nucleosides
- A two base dTsdT extension at 3' end of both sense and anti sense sequences was introduced
- The sequence file was converted to a text file to make it compatible for loading in the MerMade 192 synthesis software Synthesis, Cleavage and Deprotection The synthesis of COL1A1, TGFβ and SMAD2/3 RNA sequences used solid supported oligonucleotide synthesis using phosphoramidite chemistry.

The synthesis of the above sequences was performed at 1 um scale in 96 well plates. The amidite solutions were prepared at 0.1M concentration and ethyl thio tetrazole (0.6M in Acetonitrile) was used as activator.

The synthesized sequences were cleaved and deprotected in 96 well plates, using methylamine in the first step and fluoride reagent in the second step. The crude sequences were precipitated using acetone:ethanol (80:20) mix and the pellet were re-suspended in 0.02M sodium acetate buffer. Samples from each sequence were analyzed by LC-MS to confirm the identity, UV for quantification and a selected set of samples by IEX chromatography to determine purity.

Purification and Desalting

COL1A1, TGFβ and SMAD2/3 RNA sequences were purified on AKTA explorer purification system using Source 15Q column. A column temperature of 65 C was maintained during purification. Sample injection and collection was performed in 96 well (1.8 mL-deep well) plates. A single peak corresponding to the full length sequence was collected in the eluent. The purified sequences were desalted on a Sephadex G25 column using AKTA purifier. The desalted COL1A1, TGFβ and SMAD2/3 sequences were analyzed for concentration (by UV measurement at A260) and purity (by ion exchange HPLC). The single strands were then submitted for annealing.

Example 3: In Vitro Screening of COL1A1 siRNA in NIH3T3 Cells

Cell Culture and Transfections

NIH3T3 cells were grown to near confluence at 37° C. in an atmosphere of 5% $CO_2$ in DMEM (INVITROGEN™) supplemented with 10% FBS before being released from the plate by trypsinization. Reverse transfection was carried out by adding 5 µl of Opti-MEM to 5 µl of siRNA duplexes per well into a 96-well plate along with 10 µl of Opti-MEM plus 0.2 µl of Lipofectamine RNAiMax per well (INVITROGEN™, Carlsbad Calif. cat #13778-150) and incubated at room temperature for 15 minutes. Cells were added to the transfection mix and incubated for 24 hours prior to RNA purification. Experiments were performed at 10 nM final duplex concentration for single dose screens with each of the COL1A1 duplexes. A subset of 10 duplexes that showed robust silencing in the 10 nM single dose screens were assayed over a range of concentrations from 10 nM to 10 fM using serial dilutions to determine their $IC_{50}$. Selected AD 21349 (SEQ ID NO: 53 and SEQ ID NO: 54) has an $IC_{50}$ of 65 pM. The siRNA tested were cross-reactive for rodent, NHP, and human (See FIG. 1).

Total RNA Isolation Using MagMAX-96 Total RNA Isolation Kit (Applied Biosystem, Forer City Calif., Part #: AM1830)

Cells were harvested and lysed in 140 µl of Lysis/Binding Solution then mixed for 1 minute at 850 rpm using and Eppendorf Thermomixer (the mixing speed was the same throughout the process). Twenty micro liters of magnetic beads and Lysis/Binding Enhancer mixture were added into cell-lysate and mixed for 5 minutes. Magnetic beads were captured using magnetic stand and the supernatant was removed without disturbing the beads. After removing supernatant, magnetic beads were washed with Wash Solution 1 (isopropanol added) and mixed for 1 minute. Beads were capture again and supernatant removed. Beads were then washed with 150 µl Wash Solution 2 (Ethanol added), captured and supernatant was removed. 50 ul of DNase mixture (MagMax turbo DNase Buffer and Turbo DNase) was then added to the beads and they were mixed for 10 to 15 minutes. After mixing, 100 µl of RNA Rebinding Solution was added and mixed for 3 minutes. Supernatant was removed and magnetic beads were washed again with 150 µl Wash Solution 2 and mixed for 1 minute and supernatant was removed completely. The magnetic beads were mixed for 2 minutes to dry before RNA was eluted with 50 µl of water.

cDNA Synthesis Using ABI High Capacity cDNA Reverse Transcription Kit (Applied Biosystems, Foster City, Calif., Cat #4368813)

A master mix of 2 µl 10× Buffer, 0.8 µl 25×dNTPs, 2 µl Random primers, 1 µl Reverse Transcriptase, 1 µl RNase inhibitor and 3.2 µl of H2O per reaction were added into 10 µl total RNA. cDNA was generated using a MJ Research or Bio-Rad C-1000 or S-1000 thermal cycler (Hercules, Calif.) through the following steps: 25° C. 10 min, 37° C. 120 min, 85° C. 5 sec, 4° C. hold.

Real Time PCR

2 µl of cDNA were added to a master mix containing 0.5 µl GAPDH TaqMan Probe (Applied Biosystems Cat #4326317E), 0.5 µl COL1A1, TGFβ or SMAD2/3 TaqMan probe and 5 µl Roche Probes Master Mix (Roche Cat #04887301001) in a total of 10 µl per well in a LightCycler 480 384 well plate (Roche cat #0472974001). Real time PCR was done in a LightCycler 480 Real Time PCR machine (Roche). Each duplex was tested in at least two independent transfections. Each transfection was assayed by qPCR in duplicate.

Figure 1:
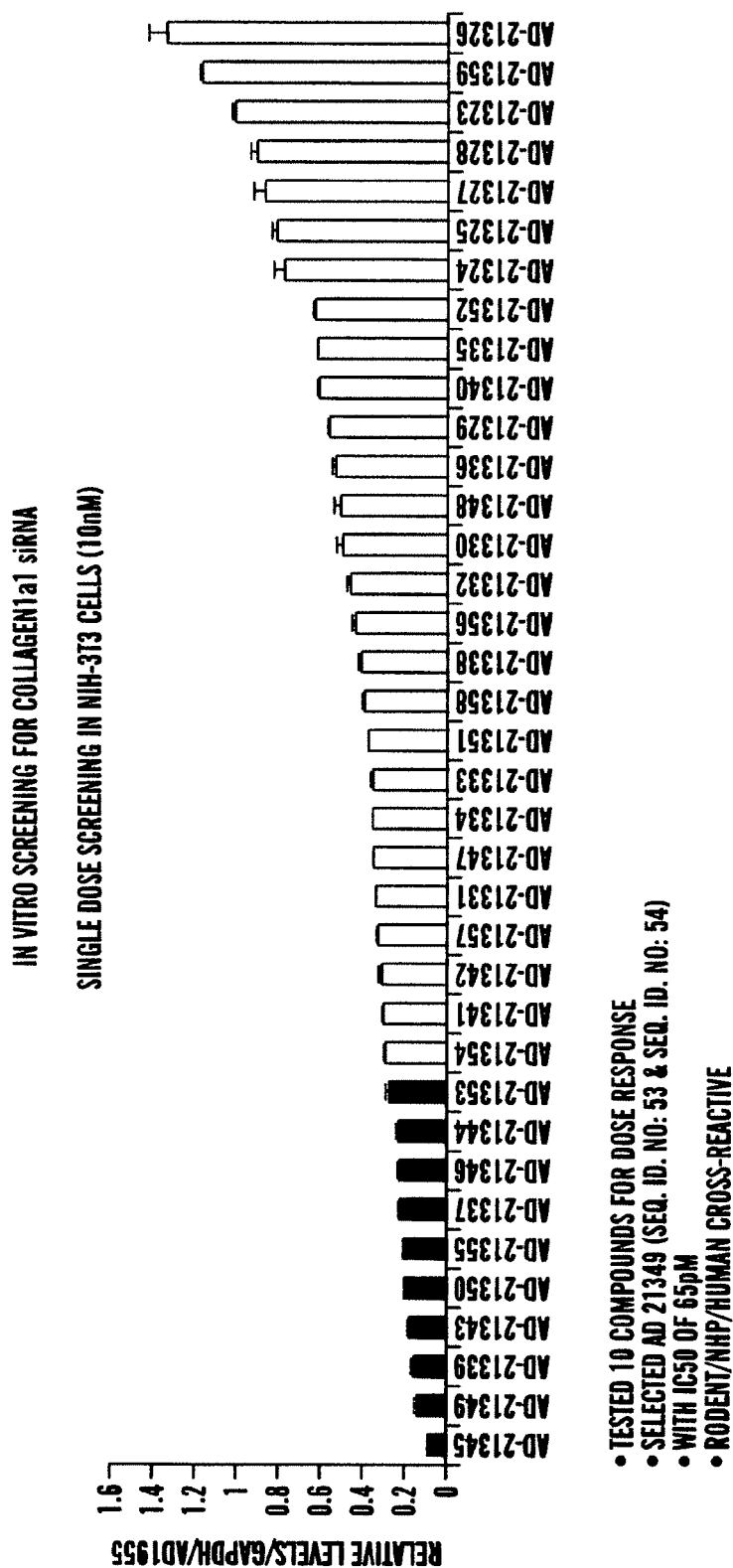
FIG. 1 shows the efficacy of single dose collagen1A1 siRNA in NIH-3T3 cells in vitro. siRNA AD-21349 (SEQ ID NO: 53 and SEQ ID NO: 54), has an $IC_{50}$ of ~65 pM on the production of COL1A1 mRNA.

Real time data were analyzed using the ΔΔCt method. Each sample was normalized to GAPDH expression and knockdown was assessed relative to cells transfected with the non-targeting duplex AD-1955. $IC_{50}$s were defined using a 4 parameter fit model in XLfit. As shown in FIG. 1, the efficacy of single doses of collagen1A1 siRNA in NIH-3T3 cells was examined in vitro. siRNA AD-21349 (SEQ ID NO: 53 and SEQ ID NO: 54), has an IC50 of ~65 pM on the production of COL1A1 mRNA.

Example 4: Carbon Tetrachloride ($CCl_4$)-Induced Mouse Liver Fibrosis Models In general, liver injury can be caused by many factors, for example, toxic chemicals such as carbon tetrachloride ($CCl_4$), diamethylnitrozamine and thioacetamide; damage due to immunological response in vivo, e.g. to heterologous serum and due to pathogens such as schistosomas and viruses; ligation of the common bile duct that leads to biliary fibrosis; and alcohol abuse. Examples of alcoholic liver injury animal models are the baboon placed on ethanol diet and the Tsukamoto/French model in rats.

The experimental mouse model use herein is one wherein liver injury is induced with the chemical $CCl_4$. This mouse model is a well-investigated chemical induced model of liver fibrosis. Hepatic pathological changes observed in $CCl_4$-treated mice include necrosis, inflammation, and fibrosis, along with increased serum alanine aminotransferase activity. Several microarray studies indicated $CCl_4$-induced up-regulation of genes involved in liver fibrogenesis, e.g. procollagen type 1A, which correlated well with prolong fibrotic changes in the liver (Jiang Y., et al., 2004, Toxicol. Sci., 79:404-410). Oral gavage of Balb/c animals with $CCl_4$ 1.75 ml/kg in mineral oil (MO), was administered on days 1 & 8. At 24 hours after the initial dose of $CCl_4$, the serum liver enzyme levels were measured. At 10 or 11 days, the animals were sacrificed and the histology of the livers was stained with Sirius red to determine the level of extracellular collagen.

The level of collagen expression was significantly increased, as were the two liver function biomarker enzymes, alanine transaminase (ALT) and aspartate transaminase (AST), within 24 of the initial dose of $CCl_4$.

Similarly, the $CCl_4$-treated mouse livers showed increased staining for extracellular collagen by way of Sirius red staining compared to control mineral oil treated animals.

Example 5: In Vivo Testing of COL1A1 siRNA in $CCl_4$ Mouse Model

To evaluate the AF09 and AF12-based delivery of siCOL1A1 for COL1A1 knock-down in the $CCl_4$ mouse model, liver injury in Balb/c animals was induced using $CCl_4$ by oral gavage (2×) on Day 1 and Day 8 at a final dose of 1.75 ml/kg. Control animals were given mineral oil only. Subsequently, on Day 9, the mice were injected intravenously with the AF09 and AF12 formulated siRNAs and then killed at about 40 hours post siRNA injection on Day 11. Control siRNA used was siLUC (AD1955). The dosage of both siCOL1A1 (AD21349) (SEQ ID NO: 53 and SEQ ID NO: 54) and siLUC (AD1955) was 3 mg/kg. The COL1A1 and GAPDH mRNA levels in liver were analyzed using Taqman-QPCR. A total of 10-15 animals were used per group per condition. The COL1A1 mRNA level was normalized to that of the GAPDH mRNA level.

FIG. 2 illustrates the $CCl_4$/siRNA treatment regimen and FIG. 3 summarizes the results obtained. Both the AF09 and AF12 formulated siCOL1A1 (AD21349) (SEQ ID NO: 53 and SEQ ID NO: 54) significantly reduced the level of the COL1A1 mRNA level compared to the control siLUC siRNA in $CCl_4$-treated mice. In addition, COL1A1 knockdown with AF12-21349 (SEQ ID NO: 53 and SEQ ID NO: 54) was better than AF09-21349 at 3 mg/Kg.

To evaluate the dosage response of the AF12-based delivery siCOL1A1 in the $CCl_4$-treated mouse model, liver injury in Balb/c animals was induced using $CCl_4$ by oral gavage (2×) on Day 1 and Day 8 at a final dose of 1.75 ml/kg. Control animals were given mineral oil only. On Day 9, the mice were injected intravenously with the AF12 formulated siRNA at various dosages and then killed at about 40 hours post siRNA injection on Day 11. Control siRNA used was AF12_LUC (AD1955). The dosages of both AF12_COL1A1 (AD21349) (SEQ ID NO: 53 and SEQ ID NO: 54) and siLUC (AD1955) ranged from 0.1 mg/kg to 3 mg/kg. The COL1A1 and GAPDH mRNA levels in liver were analyzed using Taqman-QPCR. A total of 10 animals were used per group per dosage and 5 animals were used for the mineral oil control group. The COL1A1 mRNA level was normalized to that of the GAPDH mRNA level.

FIG. 4 illustrates the dosage response in the $CCl_4$/siRNA treatment regimen and FIG. 5 summarizes the results obtained. The AF12_COL1A1 (AD21349) (SEQ ID NO: 53 and SEQ ID NO: 54) formulation at dosages of 3 mg/kg, 1 mg/kg, and 0.5 mg/kg significantly reduced the level of the COL1A1 mRNA level as compared to the control siLUC siRNA in $CCl_4$ treated mice. The $ED_{50}$ was ~0.1 mg/kg for COL1A1 knockdown with AF12-AD21349 (SEQ ID NO: 53 and SEQ ID NO: 54). The data was normalized to AF12_Luc.

To evaluate the AF11-based delivery of siCOL1A1 in the mouse model, liver injury in Balb/c animals was induced using $CCl_4$ by oral gavage (2×) on Day 1 and Day 7 at a final dose of 1.75 ml/kg. Control animals were given mineral oil only. On Day 8, the mice were injected intravenously with the AF11 formulated siRNAs at various doses and then killed at about 40 hours post siRNA injection on Day 10. Control siRNA used was siLUC (AD1955). The dosage of both siCOL1A1 (AD21349) (SEQ ID NO: 53 and SEQ ID NO: 54) and siLUC (AD1955) was 3 mg/kg. The COL1A1 and GAPDH mRNA levels in liver were analyzed using Taqman-QPCR. A total of 10 animals were used per group per dosage, 5 animals for the mineral oil control group. The COL1A1 mRNA level was normalized to that of the GAPDH mRNA level.

Figure 7:
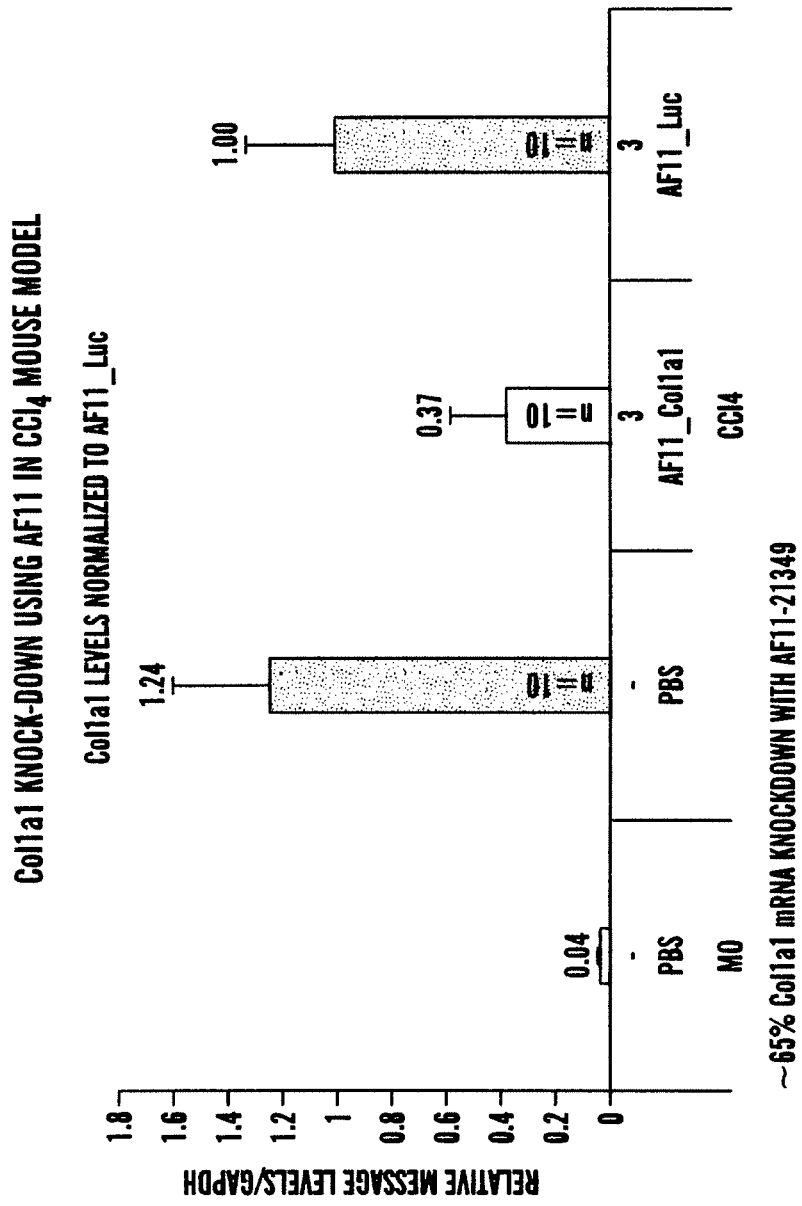
FIG. 7 demonstrates efficacy of COL1A1 knock-down in a $CCl_4$ mouse model using AF11-based delivery of siCOL1A1 AD21349 (SEQ ID NO: 53 and SEQ ID NO: 54).

FIG. 6 illustrates the $CCl_4$/AF11-SiRNA treatment regimen and FIG. 7 summarizes the results obtained. The AF11_COL1A1 (AD21349) (SEQ ID NO: 53 and SEQ ID NO: 54) formulation at dosage of 3 mg/kg significantly reduced the level of the COL1A1 mRNA level as compared to the control siLUC siRNA in $CCl_4$-treated mice. Approximately 65% COL1A1 mRNA knockdown was achieved with AF11-21349 formulation. The data was normalized to AF12 Luc.

Hepatic stellate cells (HSC) are major contributors to the abnormal matrix deposition in during liver fibrosis. These cells undergo transdifferentiation from a "quiescent" HSc into "activated" fibrogenic myofibroblasts both in chronic liver disease. The transdifferentiation is characterized by an increase in proliferation, changes in morphology with expression of α-smooth muscle actin (α-SMA), and the deposition of extracellular matrix proteins, fibrillar collgen (Friedman et al., 1992, Hepatology, 15:234-243; Friedman, 2000, J. Biol. Chem., 275:2247-2250). Uemura M. et al., (2005, Mol. Biol. Cell, 16:4214-4224) demonstrated that SMAD3 overexpression in primary rat HSC and treating primary rat HSC with TGFβ led to increased focal adhesion and α-SMA organization. This indicates that TGFβ, signalling via SMAD3, plays an important role in the morphological and functional maturation of the "activated" HSC or myofibroblasts.

Figure 8:
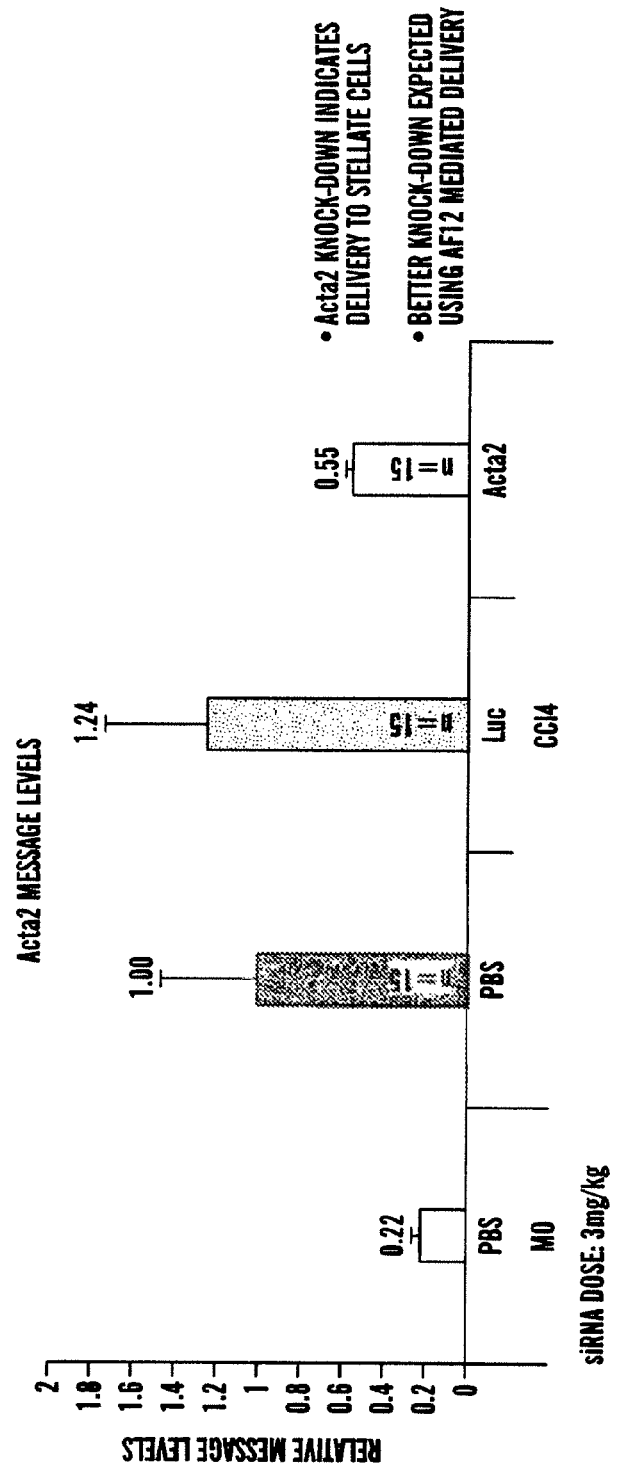
FIG. 8 demonstrates efficacy of ACTA2 knock-down in a $CCl_4$ mouse model using AF12-based delivery of siACTA2.

To confirm that the AF-based (i.e. AF09, AF11, AF12-based formulation) delivery method did deliver the siRNA to the "activated" HSC or myofibroblasts in the $CCl_4$-treated mice, the knock-down of α-SMA, which is also overexpressed in the "activated" HSC, was determined using AF09_ACTA2. α-SMA was selected as a target because it is present in activated myofibroblasts, and vascular smooth muscle cells but is absent in hepatocytes. FIG. 8 showed ACTA2 expression knock-down in the liver cells of the $CCl_4$-treated mice. This data confirmed the delivery of AF09-ACTA2 to HSC in the $CCl_4$-treated mice.

Example 6: In Vitro Screening of TGFβsiRNA in NIH3T3 Cells

NIH3T3 cells were grown, cultured and treated with siRNA as described in Example 3 except the siRNAs applied were targeted to the transforming growth factor beta 1 (TGFβ) gene. Experiments were performed at 10 nM final duplex concentration for single dose screens with each of the TGFβ duplexes (FIG. 9).

A subset of 10 duplexes that showed robust silencing in the 10 nM single dose screens was assayed over a range of concentrations from 10 nM to 10 fM using serial dilutions to determine their $IC_{50}$. Selected siRNA AD22149 (SEQ ID NO: 91 and SEQ ID NO: 92) and AD22138 (SEQ ID NO: 69 and SEQ ID NO: 70) have an $IC_{50}$ of ~20 pM and ~70 pM respectively on the mRNA of TGFβ. The siRNA tested were cross-reactive for rodent, NHP, and human.

Example 7: In Vitro Screening of SMAD2 siRNA in NIH3T3 Cells

NIH3T3 cells were grown, cultured and treated with siRNA as described in Example 3 except the siRNAs applied were targeted to the SMAD family member 2 and 3 (SMAD2 and SMAD3) genes. Experiments were performed at 10 nM final duplex concentration for single dose screens with each of the SMAD2/3 duplexes (FIG. 10).

A subset of 10 duplexes that showed robust silencing in the 10 nM sigle dose screens was assayed over a range of concentrations from 10 nM to 10 fM using serial dilutions to determine their $IC_{50}$. Selected siRNA AD-20916 (SEQ ID NO: 140 and SEQ ID NO: 141) has an $IC_{50}$ of ~75 pM on the mRNA of SMAD2.

Example 8: In Vivo Testing of SMAD2 siRNA in $CCl_4$ Mouse Model

Because SMADs are involved in the TGFβ signaling in fibrosis development, it was examined whether if knocking down SMAD expression would affect COL1A1 expression in the liver injury mouse model. To evaluate the LNP-based delivery of siSMAD2 AD-20916 (SEQ ID NO: 140 and SEQ ID NO: 141) for SMAD2 knock-down in the $CCl_4$ mouse model, liver injury in Balb/c animals was induced using $CCl_4$ by oral gavage (2×) on Day 0 at a dose of 1.75 ml/kg. Control animals were given mineral oil only. On Day 2, the mice were injected intravenously with the LNP-formulated siRNAs and then killed on Day 4 post CCl$_4$ induction. Control siRNA was siLUC (AD1955). The dosage of both siSMAD2/3 AD-20916 (SEQ ID NO: 140 and SEQ ID NO: 141) and siLUC (AD1955) was 3 mg/kg. The SMAD2 and GAPDH mRNA levels in liver were analyzed using Taqman-QPCR. A total of 10 animals were used per group per condition. The SMAD2 mRNA level was normalized to that of the GAPDH mRNA level.

FIG. 11 summarizes the results obtained. The siSMAD2/3 AD-20916 (SEQ ID NO: 140 and SEQ ID NO: 141) significantly reduced the level of the SMAD2/3 mRNA level as compared to the control siLUC siRNA in the CCl$_4$-treated mice. The reduction in SMAD2 expression was approximately 80%.

To evaluate the LNP-based delivery of siSMAD2 AD-20916 (SEQ ID NO: 140 and SEQ ID NO: 141) for SMAD2 knock-down and its effect on COL1A1 expression in the CCl$_4$ mouse model, liver injury in Balb/c animals was induced using CCl$_4$ by oral gavage (2×) on Day 0 at a dose of 1.75 ml/kg. Control animals were given mineral oil only. On Day 2, the mice were injected intravenously with the LNP-formulated siRNAs and then killed on Day 4 post CCl$_4$ induction. Control siRNA was siLUC (AD1955). The dosage of both siSMAD2/3 AD-20916 (SEQ ID NO: 140 and SEQ ID NO: 141) and siLUC (AD1955) was 3 mg/Kg. The SMAD2, COL1A1 and GAPDH mRNA levels in liver were analyzed using Taqman-QPCR. A total of 10 animals were used per group per condition. The SMAD2 mRNA level was normalized to that of the GAPDH mRNA level.

FIG. 12 summarizes the results obtained. SMAD2 knock-down using the LNP-based delivery of siSMAD2 AD-20916 led to a decrease in the expression of COL1A1 in the CCl$_4$-treated mice. The decrease was about 50-60% relative to the Luc siRNA injected animals.

Example 9: In Vivo Demonstration of COL1A1 siRNA Inhibition in a Mouse Model of Chronic Liver Disease Chronic liver disease is caused by repeated insults to the liver, resulting in a progressive process of liver destruction and regeneration, that ultimately leads to liver fibrosis and cirrhosis. To evaluate whether effective inhibition of COL1A1 can be mediated under such repeated insults to the liver, and whether such treatment is effective in reducing fibrosis under such circumstances, a mouse model of chronic liver injury was established involving multiple-insults, and the effects of repeated administration of siRNA against COL1A1 for COL1A1 knock-down were determined. In this mouse model of chronic liver injury, liver injury in Balb/c animals was induced using CCl$_4$ by oral gavage on Day 1, Day 8, Day 15, Day 22, Day 29, and Day 36 at a final dose of 1.75 ml/kg. Control animals were given mineral oil only on these same days. On Day 23, Day 27, Day 30, Day 33, and Day 37 the mice were injected intravenously with the AF09 and AF12 formulated COL1A1 siRNAs and then killed at about 40-48 hours post the final siRNA injection, i.e., on Day 39. Control siRNA used was siLUC (AD1955). The dosage of both siCOL1A1 (AD21349) (SEQ ID NO: 53 and SEQ ID NO: 54) and siLUC (AD1955) was 1 mg/kg.

The COL1A1 and GAPDH mRNA levels in liver were analyzed using Taqman-QPCR. A total of 10 animals were used per group per condition. The COL1A1 mRNA level was normalized to that of the GAPDH mRNA level.

FIG. 13 summarizes the results obtained. Surprisingly, COL1A1 knock-down using the C12-based delivery of siCOL1A1 (AD21349) (SEQ ID NO: 53 and SEQ ID NO: 54) led to a significant and unexpected decrease in the expression of COL1A1 in mice receiving multiple (×6) liver insults over a 39 day period. The decrease was about 95% relative to the Luc siRNA injected animals.

Example 10: In Vivo Demonstration of COL1A1 siRNA Inhibition in Mouse Models of Chronic Liver Disease (CCl$_4$ Model, TAA Model, and Bile Duct Ligation Model)

The CCl$_4$ model leads to liver damage that is severely shifted to the pericentral region only, and thus is a good model of liver damage to the pericentral region of the liver.

The TAA model leads to uniform liver damage (i.e., pericentral and periportal). The TAA model is slower than CCl$_4$, and thus is considered to more closely mimic liver injury developing in the human population.

The bile duct-ligated model is mediated by ligation or cannulation of bile-duct. This model effects the periductal regions and is a good model for biliary fibrosis in humans. In contrast to the other two models, the bile duct ligation model results in continued and progressive injury, i.e., chronic liver disease.

FIG. 16 demonstrates experimental design and efficacy of COL1A1 knock-down in a bile duct ligation mouse model using AF12-based delivery of siCOL1A1 AD21349 (SEQ ID NO: 53 and SEQ ID NO: 54).

Figure 17:
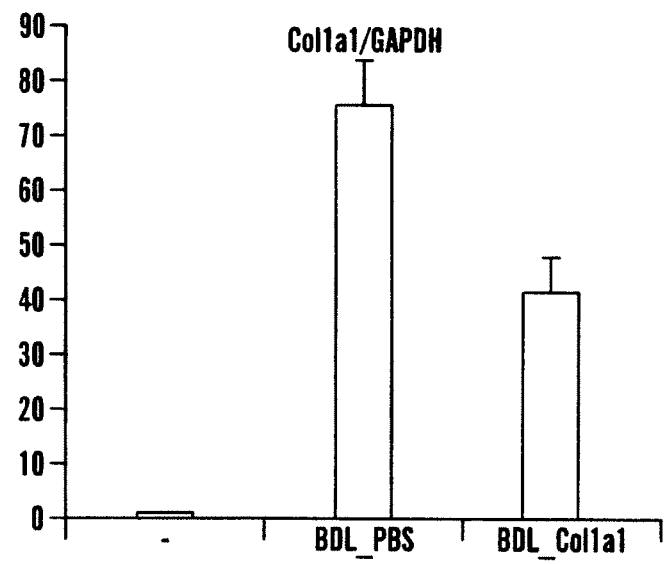
FIG. 17 shows relative Col1a1 expression in bile duct ligated animals.

FIG. 17 shows relative Col1a1 expression in bile duct ligated animals.

Figure 18:
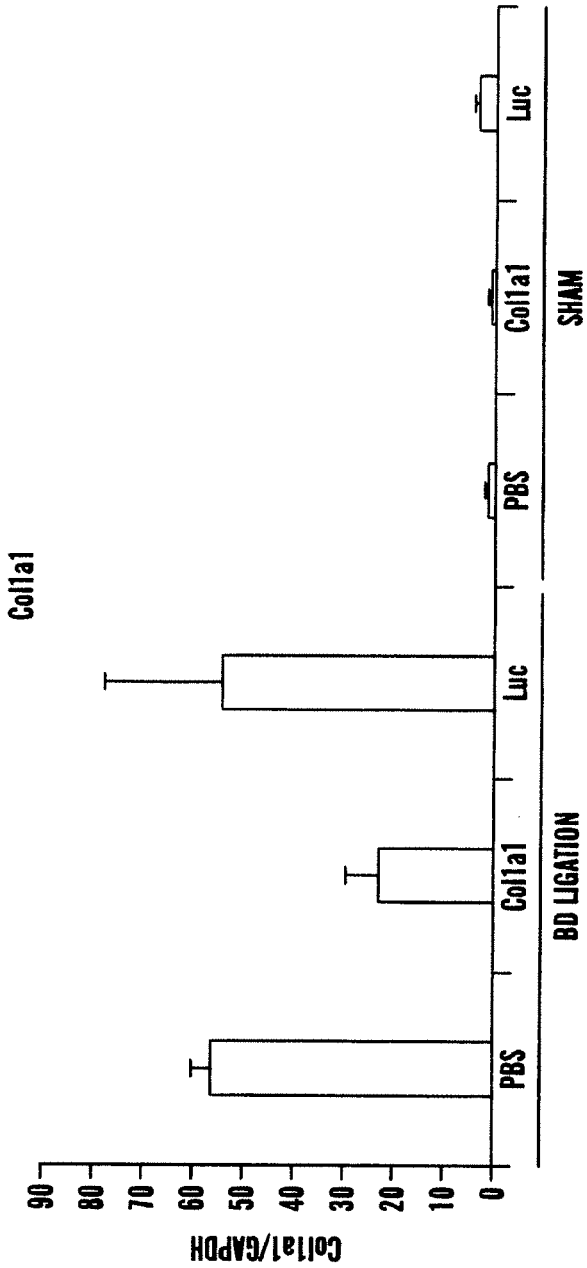
FIG. 18 demonstrates efficacy of COL1A1 knock-down in a bile duct ligation mouse model using siCOL1A1 AD21349 (SEQ ID NO: 53 and SEQ ID NO: 54).

FIG. 18 demonstrates efficacy of COL1A1 knock-down in a bile duct ligation mouse model using siCOL1A1 AD21349 (SEQ ID NO: 53 and SEQ ID NO: 54).

Figure 19:
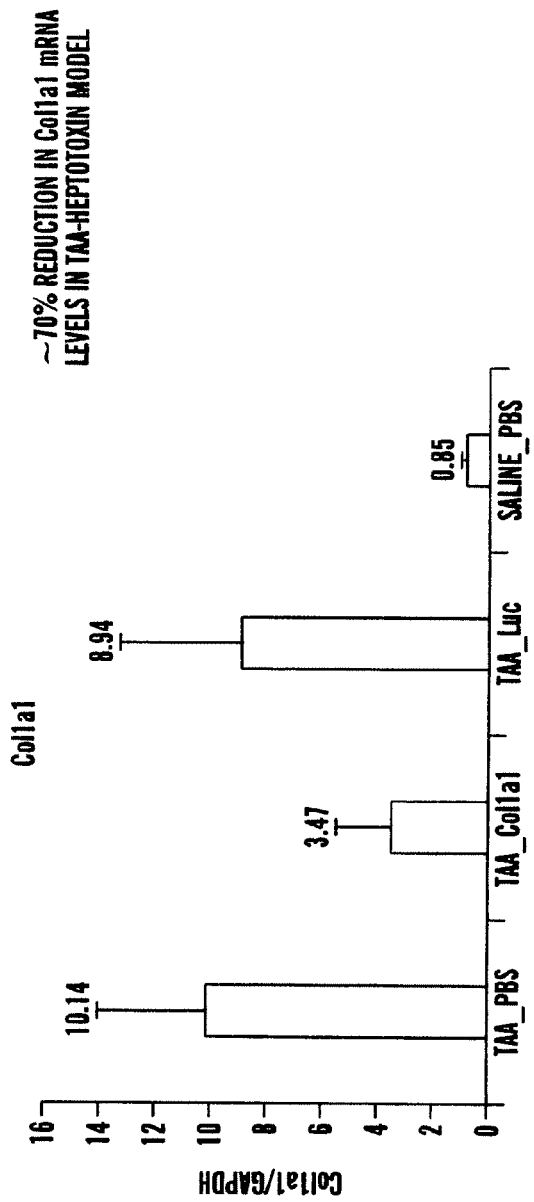
FIG. 19 demonstrates experimental design and efficacy of COL1A1 knock-down in a TAA mouse model of liver injury using siCOL1A1 AD21349 (SEQ ID NO: 53 and SEQ ID NO: 54).

FIG. 19 demonstrates experimental design and efficacy of COL1A1 knock-down in a TAA mouse model of liver injury using siCOL1A1 AD21349 (SEQ ID NO: 53 and SEQ ID NO: 54).

TABLE 2

Exemplary diseases in which fibrosis can be reduced by treating the underlying disorder

| Disease | Therapy |
| --- | --- |
| Hepatitis B | Lamivudine, others |
| Hepatitis C | Interferon alpha |
| Autoimmune hepatitis | Corticosteroids |
| Bile duct obstruction | Surgical decompression |
| Hemochromatosis | Iron depletion |
| Alcoholic hepatitis[b] | Corticosteroids |
| Primary biliary cirrhosis[b] | Ursodeoxycholic acid, MTX |
| Non-alcholic steatohepatitis[c] | PPAR gamma ligands |

TABLE 3

COL1A1 siRNA Duplexes

| Sense and Corresponding Antisense Duplexes | | Sense and Corresponding Antisense Duplexes | |
|---|---|---|---|
| Sense Strand | Corresponding Antisense Strand | Sense Strand | Corresponding Antisense Strand |
| SEQ ID NO: 1 sense | SEQ ID NO: 2 antisense | SEQ ID NO: 3 sense | SEQ ID NO: 4 antisense |
| SEQ ID NO: 5 sense | SEQ ID NO: 6 antisense | SEQ ID NO: 7 sense | SEQ ID NO: 8 antisense |
| SEQ ID NO: 9 sense | SEQ ID NO: 10 antisense | SEQ ID NO: 11 sense | SEQ ID NO: 12 antisense |
| SEQ ID NO: 13 sense | SEQ ID NO: 14 antisense | SEQ ID NO: 15 sense | SEQ ID NO: 16 antisense |
| SEQ ID NO: 17 sense | SEQ ID NO: 18 antisense | SEQ ID NO: 19 sense | SEQ ID NO: 20 antisense |
| SEQ ID NO: 21 sense | SEQ ID NO: 22 antisense | SEQ ID NO: 23 sense | SEQ ID NO: 24 antisense |
| SEQ ID NO: 25 sense | SEQ ID NO: 26 antisense | SEQ ID NO: 27 sense | SEQ ID NO: 28 antisense |
| SEQ ID NO: 29 sense | SEQ ID NO: 30 antisense | SEQ ID NO: 31 sense | SEQ ID NO: 32 antisense |
| SEQ ID NO: 33 sense | SEQ ID NO: 34 antisense | SEQ ID NO: 35 sense | SEQ ID NO: 36 antisense |
| SEQ ID NO: 37 sense | SEQ ID NO: 38 antisense | SEQ ID NO: 39 sense | SEQ ID NO: 40 antisense |
| SEQ ID NO: 41 sense | SEQ ID NO: 42 antisense | SEQ ID NO: 43 sense | SEQ ID NO: 44 antisense |
| SEQ ID NO: 45 sense | SEQ ID NO: 46 antisense | SEQ ID NO: 47 sense | SEQ ID NO: 48 antisense |
| SEQ ID NO: 49 sense | SEQ ID NO: 50 antisense | SEQ ID NO: 51 sense | SEQ ID NO: 52 antisense |
| SEQ ID NO: 53 sense | SEQ ID NO: 54 antisense | SEQ ID NO: 55 sense | SEQ ID NO: 56 antisense |
| SEQ ID NO: 57 sense | SEQ ID NO: 58 antisense | SEQ ID NO: 59 sense | SEQ ID NO: 60 antisense |
| SEQ ID NO: 61 sense | SEQ ID NO: 62 antisense | | |

TABLE 4

TGF-β siRNA duplexes

| Sense and Corresponding Antisense Duplexes | | Sense and Corresponding Antisense Duplexes | |
|---|---|---|---|
| Sense Strand | Corresponding Antisense Strand | Sense Strand | Corresponding Antisense Strand |
| SEQ ID NO: 63 sense | SEQ ID NO: 64 antisense | SEQ ID NO: 65 sense | SEQ ID NO: 66 antisense |
| SEQ ID NO: 67 sense | SEQ ID NO: 68 antisense | SEQ ID NO: 69 sense | SEQ ID NO: 70 antisense |
| SEQ ID NO: 71 sense | SEQ ID NO: 72 antisense | SEQ ID NO: 73 sense | SEQ ID NO: 74 antisense |
| SEQ ID NO: 75 sense | SEQ ID NO: 76 antisense | SEQ ID NO: 77 sense | SEQ ID NO: 78 antisense |
| SEQ ID NO: 79 sense | SEQ ID NO: 80 antisense | SEQ ID NO: 81 sense | SEQ ID NO: 82 antisense |
| SEQ ID NO: 83 sense | SEQ ID NO: 84 antisense | SEQ ID NO: 85 sense | SEQ ID NO: 86 antisense |
| SEQ ID NO: 87 sense | SEQ ID NO: 88 antisense | SEQ ID NO: 89 sense | SEQ ID NO: 90 antisense |
| SEQ ID NO: 91 sense | SEQ ID NO: 92 antisense | SEQ ID NO: 93 sense | SEQ ID NO: 94 antisense |
| SEQ ID NO: 95 sense | SEQ ID NO: 96 antisense | SEQ ID NO: 97 sense | SEQ ID NO: 98 antisense |
| SEQ ID NO: 99 sense | SEQ ID NO: 100 antisense | SEQ ID NO: 101 sense | SEQ ID NO: 102 antisense |
| SEQ ID NO: 103 sense | SEQ ID NO: 104 antisense | SEQ ID NO: 105 sense | SEQ ID NO: 106 antisense |
| SEQ ID NO: 107 sense | SEQ ID NO: 108 antisense | SEQ ID NO: 109 sense | SEQ ID NO: 110 antisense |
| SEQ ID NO: 111 sense | SEQ ID NO: 112 antisense | SEQ ID NO: 113 sense | SEQ ID NO: 114 antisense |
| SEQ ID NO: 115 sense | SEQ ID NO: 116 antisense | SEQ ID NO: 117 sense | SEQ ID NO: 118 antisense |
| SEQ ID NO: 119 sense | SEQ ID NO: 120 antisense | SEQ ID NO: 121 sense | SEQ ID NO: 122 antisense |
| SEQ ID NO: 123 sense | SEQ ID NO: 124 antisense | SEQ ID NO: 125 sense | SEQ ID NO: 126 antisense |
| SEQ ID NO: 127 sense | SEQ ID NO: 128 antisense | SEQ ID NO: 129 sense | SEQ ID NO: 130 antisense |

TABLE 5

SMAD2/3 siRNA duplexes

| Sense and Corresponding Antisense Duplexes | | Sense and Corresponding Antisense Duplexes | |
|---|---|---|---|
| Sense Strand | Corresponding Antisense Strand | Sense Strand | Corresponding Antisense Strand |
| SEQ ID NO: 132 sense | SEQ ID NO: 133 antisense | SEQ ID NO: 134 Sense | SEQ ID NO: 135 antisense |
| SEQ ID NO: 136 sense | SEQ ID NO: 137 antisense | SEQ ID NO: 138 Sense | SEQ ID NO: 139 antisense |
| SEQ ID NO: 140 sense | SEQ ID NO: 141 antisense | SEQ ID NO: 142 Sense | SEQ ID NO: 143 antisense |
| SEQ ID NO: 144 sense | SEQ ID NO: 145 antisense | SEQ ID NO: 146 Sense | SEQ ID NO: 147 antisense |
| SEQ ID NO: 148 sense | SEQ ID NO: 149 antisense | SEQ ID NO: 150 Sense | SEQ ID NO: 151 antisense |
| SEQ ID NO: 152 sense | SEQ ID NO: 153 antisense | SEQ ID NO: 154 Sense | SEQ ID NO: 155 antisense |
| SEQ ID NO: 156 sense | SEQ ID NO: 157 antisense | SEQ ID NO: 158 Sense | SEQ ID NO: 159 antisense |
| SEQ ID NO: 160 sense | SEQ ID NO: 161 antisense | SEQ ID NO: 162 Sense | SEQ ID NO: 163 antisense |
| SEQ ID NO: 164 sense | SEQ ID NO: 165 antisense | SEQ ID NO: 166 Sense | SEQ ID NO: 167 antisense |

TABLE 6

Human COL1A1 iRNA Sequences Designed on the Basis of the Human COL1A1 Transcript NM_000088.3 (SEQ ID NO: 172) that are Cross-Reactive with Mouse Col1a1 Transcript NM_007742.3 (SEQ ID NO: 173)

| Sense and Corresponding Antisense Duplexes | | | | Sense and Corresponding Antisense Duplexes | | | |
|---|---|---|---|---|---|---|---|
| Sense Strand | | Corresponding Anti sense Strand | | Sense Strand | | Corresponding Antisense Strand | |
| SEQ ID NO: 185 | sense | SEQ ID NO: 186 | antisense | SEQ ID NO: 187 | sense | SEQ ID NO: 188 | antisense |
| SEQ ID NO: 189 | sense | SEQ ID NO: 190 | antisense | SEQ ID NO: 191 | sense | SEQ ID NO: 192 | antisense |
| SEQ ID NO: 193 | sense | SEQ ID NO: 194 | antisense | SEQ ID NO: 195 | sense | SEQ ID NO: 196 | antisense |
| SEQ ID NO: 197 | sense | SEQ ID NO: 198 | antisense | SEQ ID NO: 199 | sense | SEQ ID NO: 200 | antisense |
| SEQ ID NO: 201 | sense | SEQ ID NO: 202 | antisense | SEQ ID NO: 203 | sense | SEQ ID NO: 204 | antisense |
| SEQ ID NO: 205 | sense | SEQ ID NO: 206 | antisense | SEQ ID NO: 207 | sense | SEQ ID NO: 208 | antisense |
| SEQ ID NO: 209 | sense | SEQ ID NO: 210 | antisense | SEQ ID NO: 211 | sense | SEQ ID NO: 212 | antisense |
| SEQ ID NO: 213 | sense | SEQ ID NO: 214 | antisense | SEQ ID NO: 215 | sense | SEQ ID NO: 216 | antisense |
| SEQ ID NO: 217 | sense | SEQ ID NO: 218 | antisense | SEQ ID NO: 219 | sense | SEQ ID NO: 220 | antisense |
| SEQ ID NO: 221 | sense | SEQ ID NO: 222 | antisense | SEQ ID NO: 223 | sense | SEQ ID NO: 224 | antisense |
| SEQ ID NO: 225 | sense | SEQ ID NO: 226 | antisense | SEQ ID NO: 227 | sense | SEQ ID NO: 228 | antisense |
| SEQ ID NO: 229 | sense | SEQ ID NO: 230 | antisense | SEQ ID NO: 231 | sense | SEQ ID NO: 232 | antisense |
| SEQ ID NO: 233 | sense | SEQ ID NO: 234 | antisense | SEQ ID NO: 235 | sense | SEQ ID NO: 236 | antisense |
| SEQ ID NO: 237 | sense | SEQ ID NO: 238 | antisense | SEQ ID NO: 239 | sense | SEQ ID NO: 240 | antisense |
| SEQ ID NO: 241 | sense | SEQ ID NO: 242 | antisense | SEQ ID NO: 243 | sense | SEQ ID NO: 244 | antisense |
| SEQ ID NO: 245 | sense | SEQ ID NO: 246 | antisense | SEQ ID NO: 247 | sense | SEQ ID NO: 248 | antisense |
| SEQ ID NO: 249 | sense | SEQ ID NO: 250 | antisense | SEQ ID NO: 251 | sense | SEQ ID NO: 252 | antisense |
| SEQ ID NO: 253 | sense | SEQ ID NO: 254 | antisense | SEQ ID NO: 255 | sense | SEQ ID NO: 256 | antisense |
| SEQ ID NO: 257 | sense | SEQ ID NO: 258 | antisense | SEQ ID NO: 259 | sense | SEQ ID NO: 260 | antisense |
| SEQ ID NO: 261 | sense | SEQ ID NO: 262 | antisense | SEQ ID NO: 263 | sense | SEQ ID NO: 264 | antisense |
| SEQ ID NO: 265 | sense | SEQ ID NO: 266 | antisense | SEQ ID NO: 267 | sense | SEQ ID NO: 268 | antisense |
| SEQ ID NO: 269 | sense | SEQ ID NO: 270 | antisense | SEQ ID NO: 271 | sense | SEQ ID NO: 272 | antisense |
| SEQ ID NO: 273 | sense | SEQ ID NO: 274 | antisense | SEQ ID NO: 275 | sense | SEQ ID NO: 276 | antisense |
| SEQ ID NO: 277 | sense | SEQ ID NO: 278 | antisense | SEQ ID NO: 279 | sense | SEQ ID NO: 280 | antisense |
| SEQ ID NO: 281 | sense | SEQ ID NO: 282 | antisense | SEQ ID NO: 283 | sense | SEQ ID NO: 284 | antisense |
| SEQ ID NO: 285 | sense | SEQ ID NO: 286 | antisense | SEQ ID NO: 287 | sense | SEQ ID NO: 288 | antisense |
| SEQ ID NO: 289 | sense | SEQ ID NO: 290 | antisense | SEQ ID NO: 291 | sense | SEQ ID NO: 292 | antisense |
| SEQ ID NO: 293 | sense | SEQ ID NO: 294 | antisense | SEQ ID NO: 295 | sense | SEQ ID NO: 296 | antisense |
| SEQ ID NO: 297 | sense | SEQ ID NO: 298 | antisense | SEQ ID NO: 299 | sense | SEQ ID NO: 300 | antisense |
| SEQ ID NO: 301 | sense | SEQ ID NO: 302 | antisense | SEQ ID NO: 303 | sense | SEQ ID NO: 304 | antisense |
| SEQ ID NO: 305 | sense | SEQ ID NO: 306 | antisense | SEQ ID NO: 307 | sense | SEQ ID NO: 308 | antisense |
| SEQ ID NO: 309 | sense | SEQ ID NO: 310 | antisense | SEQ ID NO: 311 | sense | SEQ ID NO: 312 | antisense |
| SEQ ID NO: 313 | sense | SEQ ID NO: 314 | antisense | SEQ ID NO: 315 | sense | SEQ ID NO: 316 | antisense |
| SEQ ID NO: 317 | sense | SEQ ID NO: 318 | antisense | SEQ ID NO: 319 | sense | SEQ ID NO: 320 | antisense |
| SEQ ID NO: 321 | sense | SEQ ID NO: 322 | antisense | SEQ ID NO: 323 | sense | SEQ ID NO: 324 | antisense |
| SEQ ID NO: 325 | sense | SEQ ID NO: 326 | antisense | SEQ ID NO: 327 | sense | SEQ ID NO: 328 | antisense |
| SEQ ID NO: 329 | sense | SEQ ID NO: 330 | antisense | SEQ ID NO: 331 | sense | SEQ ID NO: 332 | antisense |
| SEQ ID NO: 333 | sense | SEQ ID NO: 334 | antisense | SEQ ID NO: 335 | sense | SEQ ID NO: 336 | antisense |
| SEQ ID NO: 337 | sense | SEQ ID NO: 338 | antisense | SEQ ID NO: 339 | sense | SEQ ID NO: 340 | antisense |
| SEQ ID NO: 341 | sense | SEQ ID NO: 342 | antisense | SEQ ID NO: 343 | sense | SEQ ID NO: 344 | antisense |
| SEQ ID NO: 345 | sense | SEQ ID NO: 346 | antisense | SEQ ID NO: 347 | sense | SEQ ID NO: 348 | antisense |
| SEQ ID NO: 349 | sense | SEQ ID NO: 350 | antisense | SEQ ID NO: 351 | sense | SEQ ID NO: 352 | antisense |
| SEQ ID NO: 353 | sense | SEQ ID NO: 354 | antisense | SEQ ID NO: 355 | sense | SEQ ID NO: 356 | antisense |
| SEQ ID NO: 357 | sense | SEQ ID NO: 358 | antisense | SEQ ID NO: 359 | sense | SEQ ID NO: 360 | antisense |
| SEQ ID NO: 361 | sense | SEQ ID NO: 362 | antisense | SEQ ID NO: 363 | sense | SEQ ID NO: 364 | antisense |
| SEQ ID NO: 365 | sense | SEQ ID NO: 366 | antisense | SEQ ID NO: 367 | sense | SEQ ID NO: 368 | antisense |
| SEQ ID NO: 369 | sense | SEQ ID NO: 370 | antisense | SEQ ID NO: 371 | sense | SEQ ID NO: 372 | antisense |
| SEQ ID NO: 373 | sense | SEQ ID NO: 374 | antisense | SEQ ID NO: 375 | sense | SEQ ID NO: 376 | antisense |
| SEQ ID NO: 377 | sense | SEQ ID NO: 378 | antisense | SEQ ID NO: 379 | sense | SEQ ID NO: 380 | antisense |
| SEQ ID NO: 381 | sense | SEQ ID NO: 382 | antisense | SEQ ID NO: 383 | sense | SEQ ID NO: 384 | antisense |
| SEQ ID NO: 385 | sense | SEQ ID NO: 386 | antisense | SEQ ID NO: 387 | sense | SEQ ID NO: 388 | antisense |
| SEQ ID NO: 389 | sense | SEQ ID NO: 390 | antisense | SEQ ID NO: 391 | sense | SEQ ID NO: 392 | antisense |
| SEQ ID NO: 393 | sense | SEQ ID NO: 394 | antisense | SEQ ID NO: 395 | sense | SEQ ID NO: 396 | antisense |
| SEQ ID NO: 397 | sense | SEQ ID NO: 398 | antisense | SEQ ID NO: 399 | sense | SEQ ID NO: 400 | antisense |
| SEQ ID NO: 401 | sense | SEQ ID NO: 402 | antisense | SEQ ID NO: 403 | sense | SEQ ID NO: 404 | antisense |
| SEQ ID NO: 405 | sense | SEQ ID NO: 406 | antisense | SEQ ID NO: 407 | sense | SEQ ID NO: 408 | antisense |
| SEQ ID NO: 409 | sense | SEQ ID NO: 410 | antisense | SEQ ID NO: 411 | sense | SEQ ID NO: 412 | antisense |
| SEQ ID NO: 413 | sense | SEQ ID NO: 414 | antisense | SEQ ID NO: 415 | sense | SEQ ID NO: 416 | antisense |
| SEQ ID NO: 417 | sense | SEQ ID NO: 418 | antisense | SEQ ID NO: 419 | sense | SEQ ID NO: 420 | antisense |
| SEQ ID NO: 421 | sense | SEQ ID NO: 422 | antisense | SEQ ID NO: 423 | sense | SEQ ID NO: 424 | antisense |
| SEQ ID NO: 425 | sense | SEQ ID NO: 426 | antisense | SEQ ID NO: 427 | sense | SEQ ID NO: 428 | antisense |
| SEQ ID NO: 429 | sense | SEQ ID NO: 430 | antisense | SEQ ID NO: 431 | sense | SEQ ID NO: 432 | antisense |
| SEQ ID NO: 433 | sense | SEQ ID NO: 434 | antisense | SEQ ID NO: 435 | sense | SEQ ID NO: 436 | antisense |
| SEQ ID NO: 437 | sense | SEQ ID NO: 438 | antisense | SEQ ID NO: 439 | sense | SEQ ID NO: 440 | antisense |
| SEQ ID NO: 441 | sense | SEQ ID NO: 442 | antisense | SEQ ID NO: 443 | sense | SEQ ID NO: 444 | antisense |
| SEQ ID NO: 445 | sense | SEQ ID NO: 446 | antisense | SEQ ID NO: 447 | sense | SEQ ID NO: 448 | antisense |
| SEQ ID NO: 449 | sense | SEQ ID NO: 450 | antisense | SEQ ID NO: 451 | sense | SEQ ID NO: 452 | antisense |
| SEQ ID NO: 453 | sense | SEQ ID NO: 454 | antisense | SEQ ID NO: 455 | sense | SEQ ID NO: 456 | antisense |
| SEQ ID NO: 457 | sense | SEQ ID NO: 458 | antisense | SEQ ID NO: 459 | sense | SEQ ID NO: 460 | antisense |
| SEQ ID NO: 461 | sense | SEQ ID NO: 462 | antisense | SEQ ID NO: 463 | sense | SEQ ID NO: 464 | antisense |
| SEQ ID NO: 465 | sense | SEQ ID NO: 466 | antisense | SEQ ID NO: 467 | sense | SEQ ID NO: 468 | antisense |
| SEQ ID NO: 469 | sense | SEQ ID NO: 470 | antisense | SEQ ID NO: 471 | sense | SEQ ID NO: 472 | antisense |

TABLE 6-continued

Human COL1A1 iRNA Sequences Designed on the Basis of the Human COL1A1 Transcript NM_000088.3
(SEQ ID NO: 172) that are Cross-Reactive with Mouse Col1a1 Transcript NM_007742.3 (SEQ ID NO: 173)

| Sense and Corresponding Antisense Duplexes | | | | Sense and Corresponding Antisense Duplexes | | | |
|---|---|---|---|---|---|---|---|
| Sense Strand | | Corresponding Antisense Strand | | Sense Strand | | Corresponding Antisense Strand | |
| SEQ ID NO: 473 | sense | SEQ ID NO: 474 | antisense | SEQ ID NO: 475 | sense | SEQ ID NO: 476 | antisense |
| SEQ ID NO: 477 | sense | SEQ ID NO: 478 | antisense | SEQ ID NO: 479 | sense | SEQ ID NO: 480 | antisense |
| SEQ ID NO: 481 | sense | SEQ ID NO: 482 | antisense | SEQ ID NO: 483 | sense | SEQ ID NO: 484 | antisense |
| SEQ ID NO: 485 | sense | SEQ ID NO: 486 | antisense | SEQ ID NO: 487 | sense | SEQ ID NO: 488 | antisense |
| SEQ ID NO: 489 | sense | SEQ ID NO: 490 | antisense | SEQ ID NO: 491 | sense | SEQ ID NO: 492 | antisense |
| SEQ ID NO: 493 | sense | SEQ ID NO: 494 | antisense | SEQ ID NO: 495 | sense | SEQ ID NO: 496 | antisense |
| SEQ ID NO: 497 | sense | SEQ ID NO: 498 | antisense | SEQ ID NO: 499 | sense | SEQ ID NO: 500 | antisense |
| SEQ ID NO: 501 | sense | SEQ ID NO: 502 | antisense | SEQ ID NO: 503 | sense | SEQ ID NO: 504 | antisense |
| SEQ ID NO: 505 | sense | SEQ ID NO: 506 | antisense | SEQ ID NO: 507 | sense | SEQ ID NO: 508 | antisense |
| SEQ ID NO: 509 | sense | SEQ ID NO: 510 | antisense | SEQ ID NO: 511 | sense | SEQ ID NO: 512 | antisense |
| SEQ ID NO: 513 | sense | SEQ ID NO: 514 | antisense | SEQ ID NO: 515 | sense | SEQ ID NO: 516 | antisense |
| SEQ ID NO: 517 | sense | SEQ ID NO: 518 | antisense | SEQ ID NO: 519 | sense | SEQ ID NO: 520 | antisense |
| SEQ ID NO: 521 | sense | SEQ ID NO: 522 | antisense | SEQ ID NO: 523 | sense | SEQ ID NO: 524 | antisense |
| SEQ ID NO: 525 | sense | SEQ ID NO: 526 | antisense | SEQ ID NO: 527 | sense | SEQ ID NO: 528 | antisense |
| SEQ ID NO: 529 | sense | SEQ ID NO: 530 | antisense | SEQ ID NO: 531 | sense | SEQ ID NO: 532 | antisense |
| SEQ ID NO: 533 | sense | SEQ ID NO: 534 | antisense | SEQ ID NO: 535 | sense | SEQ ID NO: 536 | antisense |
| SEQ ID NO: 537 | sense | SEQ ID NO: 538 | antisense | SEQ ID NO: 539 | sense | SEQ ID NO: 540 | antisense |
| SEQ ID NO: 541 | sense | SEQ ID NO: 542 | antisense | SEQ ID NO: 543 | sense | SEQ ID NO: 544 | antisense |
| SEQ ID NO: 545 | sense | SEQ ID NO: 546 | antisense | SEQ ID NO: 547 | sense | SEQ ID NO: 548 | antisense |
| SEQ ID NO: 549 | sense | SEQ ID NO: 550 | antisense | SEQ ID NO: 551 | sense | SEQ ID NO: 552 | antisense |
| SEQ ID NO: 553 | sense | SEQ ID NO: 554 | antisense | SEQ ID NO: 555 | sense | SEQ ID NO: 556 | antisense |
| SEQ ID NO: 557 | sense | SEQ ID NO: 558 | antisense | SEQ ID NO: 559 | sense | SEQ ID NO: 560 | antisense |
| SEQ ID NO: 561 | sense | SEQ ID NO: 562 | antisense | SEQ ID NO: 563 | sense | SEQ ID NO: 564 | antisense |
| SEQ ID NO: 565 | sense | SEQ ID NO: 566 | antisense | SEQ ID NO: 567 | sense | SEQ ID NO: 568 | antisense |
| SEQ ID NO: 569 | sense | SEQ ID NO: 570 | antisense | SEQ ID NO: 571 | sense | SEQ ID NO: 572 | antisense |
| SEQ ID NO: 573 | sense | SEQ ID NO: 574 | antisense | SEQ ID NO: 575 | sense | SEQ ID NO: 576 | antisense |
| SEQ ID NO: 577 | sense | SEQ ID NO: 578 | antisense | SEQ ID NO: 579 | sense | SEQ ID NO: 580 | antisense |
| SEQ ID NO: 581 | sense | SEQ ID NO: 582 | antisense | SEQ ID NO: 583 | sense | SEQ ID NO: 584 | antisense |
| SEQ ID NO: 585 | sense | SEQ ID NO: 586 | antisense | SEQ ID NO: 587 | sense | SEQ ID NO: 588 | antisense |
| SEQ ID NO: 589 | sense | SEQ ID NO: 590 | antisense | SEQ ID NO: 591 | sense | SEQ ID NO: 592 | antisense |
| SEQ ID NO: 593 | sense | SEQ ID NO: 594 | antisense | SEQ ID NO: 595 | sense | SEQ ID NO: 596 | antisense |
| SEQ ID NO: 597 | sense | SEQ ID NO: 598 | antisense | SEQ ID NO: 599 | sense | SEQ ID NO: 600 | antisense |
| SEQ ID NO: 601 | sense | SEQ ID NO: 602 | antisense | SEQ ID NO: 603 | sense | SEQ ID NO: 604 | antisense |
| SEQ ID NO: 605 | sense | SEQ ID NO: 606 | antisense | SEQ ID NO: 607 | sense | SEQ ID NO: 608 | antisense |
| SEQ ID NO: 609 | sense | SEQ ID NO: 610 | antisense | SEQ ID NO: 611 | sense | SEQ ID NO: 612 | antisense |
| SEQ ID NO: 613 | sense | SEQ ID NO: 614 | antisense | SEQ ID NO: 615 | sense | SEQ ID NO: 616 | antisense |
| SEQ ID NO: 617 | sense | SEQ ID NO: 618 | antisense | SEQ ID NO: 619 | sense | SEQ ID NO: 620 | antisense |
| SEQ ID NO: 621 | sense | SEQ ID NO: 622 | antisense | SEQ ID NO: 623 | sense | SEQ ID NO: 624 | antisense |
| SEQ ID NO: 625 | sense | SEQ ID NO: 626 | antisense | SEQ ID NO: 627 | sense | SEQ ID NO: 628 | antisense |
| SEQ ID NO: 629 | sense | SEQ ID NO: 630 | antisense | SEQ ID NO: 631 | sense | SEQ ID NO: 632 | antisense |
| SEQ ID NO: 633 | sense | SEQ ID NO: 634 | antisense | SEQ ID NO: 635 | sense | SEQ ID NO: 636 | antisense |
| SEQ ID NO: 637 | sense | SEQ ID NO: 638 | antisense | SEQ ID NO: 639 | sense | SEQ ID NO: 640 | antisense |
| SEQ ID NO: 641 | sense | SEQ ID NO: 642 | antisense | SEQ ID NO: 643 | sense | SEQ ID NO: 644 | antisense |
| SEQ ID NO: 645 | sense | SEQ ID NO: 646 | antisense | SEQ ID NO: 647 | sense | SEQ ID NO: 648 | antisense |
| SEQ ID NO: 649 | sense | SEQ ID NO: 650 | antisense | SEQ ID NO: 651 | sense | SEQ ID NO: 652 | antisense |
| SEQ ID NO: 653 | sense | SEQ ID NO: 654 | antisense | SEQ ID NO: 655 | sense | SEQ ID NO: 656 | antisense |
| SEQ ID NO: 657 | sense | SEQ ID NO: 658 | antisense | SEQ ID NO: 659 | sense | SEQ ID NO: 660 | antisense |
| SEQ ID NO: 661 | sense | SEQ ID NO: 662 | antisense | SEQ ID NO: 663 | sense | SEQ ID NO: 664 | antisense |
| SEQ ID NO: 665 | sense | SEQ ID NO: 666 | antisense | SEQ ID NO: 667 | sense | SEQ ID NO: 668 | antisense |
| SEQ ID NO: 669 | sense | SEQ ID NO: 670 | antisense | SEQ ID NO: 671 | sense | SEQ ID NO: 672 | antisense |
| SEQ ID NO: 673 | sense | SEQ ID NO: 674 | antisense | SEQ ID NO: 675 | sense | SEQ ID NO: 676 | antisense |
| SEQ ID NO: 677 | sense | SEQ ID NO: 678 | antisense | SEQ ID NO: 679 | sense | SEQ ID NO: 680 | antisense |
| SEQ ID NO: 681 | sense | SEQ ID NO: 682 | antisense | SEQ ID NO: 683 | sense | SEQ ID NO: 684 | antisense |
| SEQ ID NO: 685 | sense | SEQ ID NO: 686 | antisense | SEQ ID NO: 687 | sense | SEQ ID NO: 688 | antisense |
| SEQ ID NO: 689 | sense | SEQ ID NO: 690 | antisense | SEQ ID NO: 691 | sense | SEQ ID NO: 692 | antisense |
| SEQ ID NO: 693 | sense | SEQ ID NO: 694 | antisense | SEQ ID NO: 695 | sense | SEQ ID NO: 696 | antisense |
| SEQ ID NO: 697 | sense | SEQ ID NO: 698 | antisense | SEQ ID NO: 699 | sense | SEQ ID NO: 700 | antisense |
| SEQ ID NO: 701 | sense | SEQ ID NO: 702 | antisense | SEQ ID NO: 703 | sense | SEQ ID NO: 704 | antisense |
| SEQ ID NO: 705 | sense | SEQ ID NO: 706 | antisense | SEQ ID NO: 707 | sense | SEQ ID NO: 708 | antisense |
| SEQ ID NO: 709 | sense | SEQ ID NO: 710 | antisense | SEQ ID NO: 711 | sense | SEQ ID NO: 712 | antisense |
| SEQ ID NO: 713 | sense | SEQ ID NO: 714 | antisense | SEQ ID NO: 715 | sense | SEQ ID NO: 716 | antisense |
| SEQ ID NO: 717 | sense | SEQ ID NO: 718 | antisense | SEQ ID NO: 719 | sense | SEQ ID NO: 720 | antisense |
| SEQ ID NO: 721 | sense | SEQ ID NO: 722 | antisense | SEQ ID NO: 723 | sense | SEQ ID NO: 724 | antisense |
| SEQ ID NO: 725 | sense | SEQ ID NO: 726 | antisense | SEQ ID NO: 727 | sense | SEQ ID NO: 728 | antisense |
| SEQ ID NO: 729 | sense | SEQ ID NO: 730 | antisense | SEQ ID NO: 731 | sense | SEQ ID NO: 732 | antisense |
| SEQ ID NO: 733 | sense | SEQ ID NO: 734 | antisense | SEQ ID NO: 735 | sense | SEQ ID NO: 736 | antisense |
| SEQ ID NO: 737 | sense | SEQ ID NO: 738 | antisense | SEQ ID NO: 739 | sense | SEQ ID NO: 740 | antisense |
| SEQ ID NO: 741 | sense | SEQ ID NO: 742 | antisense | SEQ ID NO: 743 | sense | SEQ ID NO: 744 | antisense |
| SEQ ID NO: 745 | sense | SEQ ID NO: 746 | antisense | SEQ ID NO: 747 | sense | SEQ ID NO: 748 | antisense |
| SEQ ID NO: 749 | sense | SEQ ID NO: 750 | antisense | SEQ ID NO: 751 | sense | SEQ ID NO: 752 | antisense |
| SEQ ID NO: 753 | sense | SEQ ID NO: 754 | antisense | SEQ ID NO: 755 | sense | SEQ ID NO: 756 | antisense |
| SEQ ID NO: 757 | sense | SEQ ID NO: 758 | antisense | SEQ ID NO: 759 | sense | SEQ ID NO: 760 | antisense |

TABLE 6-continued

Human COL1A1 iRNA Sequences Designed on the Basis of the Human COL1A1 Transcript NM_000088.3 (SEQ ID NO: 172) that are Cross-Reactive with Mouse Col1a1 Transcript NM_007742.3 (SEQ ID NO: 173)

| Sense and Corresponding Antisense Duplexes | | | | Sense and Corresponding Antisense Duplexes | | | |
|---|---|---|---|---|---|---|---|
| Sense Strand | | Corresponding Anti sense Strand | | Sense Strand | | Corresponding Antisense Strand | |
| SEQ ID NO: 761 | sense | SEQ ID NO: 762 | antisense | SEQ ID NO: 763 | sense | SEQ ID NO: 764 | antisense |
| SEQ ID NO: 765 | sense | SEQ ID NO: 766 | antisense | SEQ ID NO: 767 | sense | SEQ ID NO: 768 | antisense |
| SEQ ID NO: 769 | sense | SEQ ID NO: 770 | antisense | SEQ ID NO: 771 | sense | SEQ ID NO: 772 | antisense |
| SEQ ID NO: 773 | sense | SEQ ID NO: 774 | antisense | SEQ ID NO: 775 | sense | SEQ ID NO: 776 | antisense |
| SEQ ID NO: 777 | sense | SEQ ID NO: 778 | antisense | SEQ ID NO: 779 | sense | SEQ ID NO: 780 | antisense |
| SEQ ID NO: 781 | sense | SEQ ID NO: 782 | antisense | SEQ ID NO: 783 | sense | SEQ ID NO: 784 | antisense |
| SEQ ID NO: 785 | sense | SEQ ID NO: 786 | antisense | SEQ ID NO: 787 | sense | SEQ ID NO: 788 | antisense |
| SEQ ID NO: 789 | sense | SEQ ID NO: 790 | antisense | SEQ ID NO: 791 | sense | SEQ ID NO: 792 | antisense |
| SEQ ID NO: 793 | sense | SEQ ID NO: 794 | antisense | SEQ ID NO: 795 | sense | SEQ ID NO: 796 | antisense |
| SEQ ID NO: 797 | sense | SEQ ID NO: 798 | antisense | SEQ ID NO: 799 | sense | SEQ ID NO: 800 | antisense |
| SEQ ID NO: 801 | sense | SEQ ID NO: 802 | antisense | SEQ ID NO: 803 | sense | SEQ ID NO: 804 | antisense |
| SEQ ID NO: 805 | sense | SEQ ID NO: 806 | antisense | SEQ ID NO: 807 | sense | SEQ ID NO: 808 | antisense |
| SEQ ID NO: 809 | sense | SEQ ID NO: 810 | antisense | SEQ ID NO: 811 | sense | SEQ ID NO: 812 | antisense |
| SEQ ID NO: 813 | sense | SEQ ID NO: 814 | antisense | SEQ ID NO: 815 | sense | SEQ ID NO: 816 | antisense |
| SEQ ID NO: 817 | sense | SEQ ID NO: 818 | antisense | SEQ ID NO: 819 | sense | SEQ ID NO: 820 | antisense |
| SEQ ID NO: 821 | sense | SEQ ID NO: 822 | antisense | SEQ ID NO: 823 | sense | SEQ ID NO: 824 | antisense |
| SEQ ID NO: 825 | sense | SEQ ID NO: 826 | antisense | SEQ ID NO: 827 | sense | SEQ ID NO: 828 | antisense |
| SEQ ID NO: 829 | sense | SEQ ID NO: 830 | antisense | SEQ ID NO: 831 | sense | SEQ ID NO: 832 | antisense |
| SEQ ID NO: 833 | sense | SEQ ID NO: 834 | antisense | SEQ ID NO: 835 | sense | SEQ ID NO: 836 | antisense |
| SEQ ID NO: 837 | sense | SEQ ID NO: 838 | antisense | SEQ ID NO: 839 | sense | SEQ ID NO: 840 | antisense |
| SEQ ID NO: 841 | sense | SEQ ID NO: 842 | antisense | SEQ ID NO: 843 | sense | SEQ ID NO: 844 | antisense |
| SEQ ID NO: 845 | sense | SEQ ID NO: 846 | antisense | SEQ ID NO: 847 | sense | SEQ ID NO: 848 | antisense |
| SEQ ID NO: 849 | sense | SEQ ID NO: 850 | antisense | SEQ ID NO: 851 | sense | SEQ ID NO: 852 | antisense |
| SEQ ID NO: 853 | sense | SEQ ID NO: 854 | antisense | SEQ ID NO: 855 | sense | SEQ ID NO: 856 | antisense |
| SEQ ID NO: 857 | sense | SEQ ID NO: 858 | antisense | SEQ ID NO: 859 | sense | SEQ ID NO: 860 | antisense |
| SEQ ID NO: 861 | sense | SEQ ID NO: 862 | antisense | SEQ ID NO: 863 | sense | SEQ ID NO: 864 | antisense |
| SEQ ID NO: 865 | sense | SEQ ID NO: 866 | antisense | SEQ ID NO: 867 | sense | SEQ ID NO: 868 | antisense |
| SEQ ID NO: 869 | sense | SEQ ID NO: 870 | antisense | SEQ ID NO: 871 | sense | SEQ ID NO: 872 | antisense |
| SEQ ID NO: 873 | sense | SEQ ID NO: 874 | antisense | SEQ ID NO: 875 | sense | SEQ ID NO: 876 | antisense |
| SEQ ID NO: 877 | sense | SEQ ID NO: 878 | antisense | SEQ ID NO: 879 | sense | SEQ ID NO: 880 | antisense |
| SEQ ID NO: 881 | sense | SEQ ID NO: 882 | antisense | SEQ ID NO: 883 | sense | SEQ ID NO: 884 | antisense |
| SEQ ID NO: 885 | sense | SEQ ID NO: 886 | antisense | SEQ ID NO: 887 | sense | SEQ ID NO: 888 | antisense |
| SEQ ID NO: 889 | sense | SEQ ID NO: 890 | antisense | SEQ ID NO: 891 | sense | SEQ ID NO: 892 | antisense |
| SEQ ID NO: 893 | sense | SEQ ID NO: 894 | antisense | SEQ ID NO: 895 | sense | SEQ ID NO: 896 | antisense |
| SEQ ID NO: 897 | sense | SEQ ID NO: 898 | antisense | SEQ ID NO: 899 | sense | SEQ ID NO: 900 | antisense |
| SEQ ID NO: 901 | sense | SEQ ID NO: 902 | antisense | SEQ ID NO: 903 | sense | SEQ ID NO: 904 | antisense |
| SEQ ID NO: 905 | sense | SEQ ID NO: 906 | antisense | SEQ ID NO: 907 | sense | SEQ ID NO: 908 | antisense |
| SEQ ID NO: 909 | sense | SEQ ID NO: 910 | antisense | SEQ ID NO: 911 | sense | SEQ ID NO: 912 | antisense |
| SEQ ID NO: 913 | sense | SEQ ID NO: 914 | antisense | SEQ ID NO: 915 | sense | SEQ ID NO: 916 | antisense |
| SEQ ID NO: 917 | sense | SEQ ID NO: 918 | antisense | SEQ ID NO: 919 | sense | SEQ ID NO: 920 | antisense |
| SEQ ID NO: 921 | sense | SEQ ID NO: 922 | antisense | SEQ ID NO: 923 | sense | SEQ ID NO: 924 | antisense |
| SEQ ID NO: 925 | sense | SEQ ID NO: 926 | antisense | SEQ ID NO: 927 | sense | SEQ ID NO: 928 | antisense |
| SEQ ID NO: 929 | sense | SEQ ID NO: 930 | antisense | SEQ ID NO: 931 | sense | SEQ ID NO: 932 | antisense |
| SEQ ID NO: 933 | sense | SEQ ID NO: 934 | antisense | SEQ ID NO: 935 | sense | SEQ ID NO: 936 | antisense |
| SEQ ID NO: 937 | sense | SEQ ID NO: 938 | antisense | SEQ ID NO: 939 | sense | SEQ ID NO: 940 | antisense |
| SEQ ID NO: 941 | sense | SEQ ID NO: 942 | antisense | SEQ ID NO: 943 | sense | SEQ ID NO: 944 | antisense |
| SEQ ID NO: 945 | sense | SEQ ID NO: 946 | antisense | SEQ ID NO: 947 | sense | SEQ ID NO: 948 | antisense |
| SEQ ID NO: 949 | sense | SEQ ID NO: 950 | antisense | SEQ ID NO: 951 | sense | SEQ ID NO: 952 | antisense |
| SEQ ID NO: 953 | sense | SEQ ID NO: 954 | antisense | SEQ ID NO: 955 | sense | SEQ ID NO: 956 | antisense |
| SEQ ID NO: 957 | sense | SEQ ID NO: 958 | antisense | SEQ ID NO: 959 | sense | SEQ ID NO: 960 | antisense |
| SEQ ID NO: 961 | sense | SEQ ID NO: 962 | antisense | SEQ ID NO: 963 | sense | SEQ ID NO: 964 | antisense |
| SEQ ID NO: 965 | sense | SEQ ID NO: 966 | antisense | SEQ ID NO: 967 | sense | SEQ ID NO: 968 | antisense |
| SEQ ID NO: 969 | sense | SEQ ID NO: 970 | antisense | SEQ ID NO: 971 | sense | SEQ ID NO: 972 | antisense |
| SEQ ID NO: 973 | sense | SEQ ID NO: 974 | antisense | SEQ ID NO: 975 | sense | SEQ ID NO: 976 | antisense |
| SEQ ID NO: 977 | sense | SEQ ID NO: 978 | antisense | SEQ ID NO: 979 | sense | SEQ ID NO: 980 | antisense |
| SEQ ID NO: 981 | sense | SEQ ID NO: 982 | antisense | SEQ ID NO: 983 | sense | SEQ ID NO: 984 | antisense |
| SEQ ID NO: 985 | sense | SEQ ID NO: 986 | antisense | SEQ ID NO: 987 | sense | SEQ ID NO: 988 | antisense |
| SEQ ID NO: 989 | sense | SEQ ID NO: 990 | antisense | SEQ ID NO: 991 | sense | SEQ ID NO: 992 | antisense |
| SEQ ID NO: 993 | sense | SEQ ID NO: 994 | antisense | SEQ ID NO: 995 | sense | SEQ ID NO: 996 | antisense |
| SEQ ID NO: 997 | sense | SEQ ID NO: 998 | antisense | SEQ ID NO: 999 | sense | SEQ ID NO: 1000 | antisense |
| SEQ ID NO: 1001 | sense | SEQ ID NO: 1002 | antisense | SEQ ID NO: 1003 | sense | SEQ ID NO: 1004 | antisense |
| SEQ ID NO: 1005 | sense | SEQ ID NO: 1006 | antisense | SEQ ID NO: 1007 | sense | SEQ ID NO: 1008 | antisense |
| SEQ ID NO: 1009 | sense | SEQ ID NO: 1010 | antisense | SEQ ID NO: 1011 | sense | SEQ ID NO: 1012 | antisense |
| SEQ ID NO: 1013 | sense | SEQ ID NO: 1014 | antisense | SEQ ID NO: 1015 | sense | SEQ ID NO: 1016 | antisense |
| SEQ ID NO: 1017 | sense | SEQ ID NO: 1018 | antisense | SEQ ID NO: 1019 | sense | SEQ ID NO: 1020 | antisense |
| SEQ ID NO: 1021 | sense | SEQ ID NO: 1022 | antisense | SEQ ID NO: 1023 | sense | SEQ ID NO: 1024 | antisense |
| SEQ ID NO: 1025 | sense | SEQ ID NO: 1026 | antisense | SEQ ID NO: 1027 | sense | SEQ ID NO: 1028 | antisense |
| SEQ ID NO: 1029 | sense | SEQ ID NO: 1030 | antisense | SEQ ID NO: 1031 | sense | SEQ ID NO: 1032 | antisense |
| SEQ ID NO: 1033 | sense | SEQ ID NO: 1034 | antisense | SEQ ID NO: 1035 | sense | SEQ ID NO: 1036 | antisense |
| SEQ ID NO: 1037 | sense | SEQ ID NO: 1038 | antisense | SEQ ID NO: 1039 | sense | SEQ ID NO: 1040 | antisense |
| SEQ ID NO: 1041 | sense | SEQ ID NO: 1042 | antisense | SEQ ID NO: 1043 | sense | SEQ ID NO: 1044 | antisense |
| SEQ ID NO: 1045 | sense | SEQ ID NO: 1046 | antisense | SEQ ID NO: 1047 | sense | SEQ ID NO: 1048 | antisense |

TABLE 6-continued

Human COL1A1 iRNA Sequences Designed on the Basis of the Human COL1A1 Transcript NM_000088.3
(SEQ ID NO: 172) that are Cross-Reactive with Mouse Col1a1 Transcript NM_007742.3 (SEQ ID NO: 173)

| Sense and Corresponding Antisense Duplexes | | | | Sense and Corresponding Antisense Duplexes | | | |
|---|---|---|---|---|---|---|---|
| Sense Strand | | Corresponding Anti sense Strand | | Sense Strand | | Corresponding Antisense Strand | |
| SEQ ID NO: 1049 | sense | SEQ ID NO: 1050 | antisense | SEQ ID NO: 1051 | sense | SEQ ID NO: 1052 | antisense |
| SEQ ID NO: 1053 | sense | SEQ ID NO: 1054 | antisense | SEQ ID NO: 1055 | sense | SEQ ID NO: 1056 | antisense |
| SEQ ID NO: 1057 | sense | SEQ ID NO: 1058 | antisense | SEQ ID NO: 1059 | sense | SEQ ID NO: 1060 | antisense |
| SEQ ID NO: 1061 | sense | SEQ ID NO: 1062 | antisense | SEQ ID NO: 1063 | sense | SEQ ID NO: 1064 | antisense |
| SEQ ID NO: 1065 | sense | SEQ ID NO: 1066 | antisense | SEQ ID NO: 1067 | sense | SEQ ID NO: 1068 | antisense |
| SEQ ID NO: 1069 | sense | SEQ ID NO: 1070 | antisense | SEQ ID NO: 1071 | sense | SEQ ID NO: 1072 | antisense |
| SEQ ID NO: 1073 | sense | SEQ ID NO: 1074 | antisense | SEQ ID NO: 1075 | sense | SEQ ID NO: 1076 | antisense |
| SEQ ID NO: 1077 | sense | SEQ ID NO: 1078 | antisense | SEQ ID NO: 1079 | sense | SEQ ID NO: 1080 | antisense |
| SEQ ID NO: 1081 | sense | SEQ ID NO: 1082 | antisense | SEQ ID NO: 1083 | sense | SEQ ID NO: 1084 | antisense |
| SEQ ID NO: 1085 | sense | SEQ ID NO: 1086 | antisense | SEQ ID NO: 1087 | sense | SEQ ID NO: 1088 | antisense |
| SEQ ID NO: 1089 | sense | SEQ ID NO: 1090 | antisense | SEQ ID NO: 1091 | sense | SEQ ID NO: 1092 | antisense |
| SEQ ID NO: 1093 | sense | SEQ ID NO: 1094 | antisense | SEQ ID NO: 1095 | sense | SEQ ID NO: 1096 | antisense |
| SEQ ID NO: 1097 | sense | SEQ ID NO: 1098 | antisense | SEQ ID NO: 1099 | sense | SEQ ID NO: 1100 | antisense |
| SEQ ID NO: 1101 | sense | SEQ ID NO: 1102 | antisense | SEQ ID NO: 1103 | sense | SEQ ID NO: 1104 | antisense |
| SEQ ID NO: 1105 | sense | SEQ ID NO: 1106 | antisense | SEQ ID NO: 1107 | sense | SEQ ID NO: 1108 | antisense |
| SEQ ID NO: 1109 | sense | SEQ ID NO: 1110 | antisense | SEQ ID NO: 1111 | sense | SEQ ID NO: 1112 | antisense |
| SEQ ID NO: 1113 | sense | SEQ ID NO: 1114 | antisense | SEQ ID NO: 1115 | sense | SEQ ID NO: 1116 | antisense |
| SEQ ID NO: 1117 | sense | SEQ ID NO: 1118 | antisense | SEQ ID NO: 1119 | sense | SEQ ID NO: 1120 | antisense |
| SEQ ID NO: 1121 | sense | SEQ ID NO: 1122 | antisense | SEQ ID NO: 1123 | sense | SEQ ID NO: 1124 | antisense |
| SEQ ID NO: 1125 | sense | SEQ ID NO: 1126 | antisense | SEQ ID NO: 1127 | sense | SEQ ID NO: 1128 | antisense |
| SEQ ID NO: 1129 | sense | SEQ ID NO: 1130 | antisense | SEQ ID NO: 1131 | sense | SEQ ID NO: 1132 | antisense |
| SEQ ID NO: 1133 | sense | SEQ ID NO: 1134 | antisense | SEQ ID NO: 1135 | sense | SEQ ID NO: 1136 | antisense |
| SEQ ID NO: 1137 | sense | SEQ ID NO: 1138 | antisense | SEQ ID NO: 1139 | sense | SEQ ID NO: 1140 | antisense |
| SEQ ID NO: 1141 | sense | SEQ ID NO: 1142 | antisense | SEQ ID NO: 1143 | sense | SEQ ID NO: 1144 | antisense |
| SEQ ID NO: 1145 | sense | SEQ ID NO: 1146 | antisense | SEQ ID NO: 1147 | sense | SEQ ID NO: 1148 | antisense |
| SEQ ID NO: 1149 | sense | SEQ ID NO: 1150 | antisense | SEQ ID NO: 1151 | sense | SEQ ID NO: 1152 | antisense |
| SEQ ID NO: 1153 | sense | SEQ ID NO: 1154 | antisense | SEQ ID NO: 1155 | sense | SEQ ID NO: 1156 | antisense |
| SEQ ID NO: 1157 | sense | SEQ ID NO: 1158 | antisense | SEQ ID NO: 1159 | sense | SEQ ID NO: 1160 | antisense |
| SEQ ID NO: 1161 | sense | SEQ ID NO: 1162 | antisense | SEQ ID NO: 1163 | sense | SEQ ID NO: 1164 | antisense |
| SEQ ID NO: 1165 | sense | SEQ ID NO: 1166 | antisense | SEQ ID NO: 1167 | sense | SEQ ID NO: 1168 | antisense |
| SEQ ID NO: 1169 | sense | SEQ ID NO: 1170 | antisense | SEQ ID NO: 1171 | sense | SEQ ID NO: 1172 | antisense |
| SEQ ID NO: 1173 | sense | SEQ ID NO: 1174 | antisense | SEQ ID NO: 1175 | sense | SEQ ID NO: 1176 | antisense |
| SEQ ID NO: 1177 | sense | SEQ ID NO: 1178 | antisense | SEQ ID NO: 1179 | sense | SEQ ID NO: 1180 | antisense |
| SEQ ID NO: 1181 | sense | SEQ ID NO: 1182 | antisense | SEQ ID NO: 1183 | sense | SEQ ID NO: 1184 | antisense |
| SEQ ID NO: 1185 | sense | SEQ ID NO: 1186 | antisense | SEQ ID NO: 1187 | sense | SEQ ID NO: 1188 | antisense |
| SEQ ID NO: 1189 | sense | SEQ ID NO: 1190 | antisense | SEQ ID NO: 1191 | sense | SEQ ID NO: 1192 | antisense |
| SEQ ID NO: 1193 | sense | SEQ ID NO: 1194 | antisense | SEQ ID NO: 1195 | sense | SEQ ID NO: 1196 | antisense |
| SEQ ID NO: 1197 | sense | SEQ ID NO: 1198 | antisense | SEQ ID NO: 1199 | sense | SEQ ID NO: 1200 | antisense |
| SEQ ID NO: 1201 | sense | SEQ ID NO: 1202 | antisense | SEQ ID NO: 1203 | sense | SEQ ID NO: 1204 | antisense |
| SEQ ID NO: 1205 | sense | SEQ ID NO: 1206 | antisense | SEQ ID NO: 1207 | sense | SEQ ID NO: 1208 | antisense |
| SEQ ID NO: 1209 | sense | SEQ ID NO: 1210 | antisense | SEQ ID NO: 1211 | sense | SEQ ID NO: 1212 | antisense |
| SEQ ID NO: 1213 | sense | SEQ ID NO: 1214 | antisense | SEQ ID NO: 1215 | sense | SEQ ID NO: 1216 | antisense |
| SEQ ID NO: 1217 | sense | SEQ ID NO: 1218 | antisense | SEQ ID NO: 1219 | sense | SEQ ID NO: 1220 | antisense |
| SEQ ID NO: 1221 | sense | SEQ ID NO: 1222 | antisense | SEQ ID NO: 1223 | sense | SEQ ID NO: 1224 | antisense |
| SEQ ID NO: 1225 | sense | SEQ ID NO: 1226 | antisense | SEQ ID NO: 1227 | sense | SEQ ID NO: 1228 | antisense |
| SEQ ID NO: 1229 | sense | SEQ ID NO: 1230 | antisense | SEQ ID NO: 1231 | sense | SEQ ID NO: 1232 | antisense |
| SEQ ID NO: 1233 | sense | SEQ ID NO: 1234 | antisense | SEQ ID NO: 1235 | sense | SEQ ID NO: 1236 | antisense |
| SEQ ID NO: 1237 | sense | SEQ ID NO: 1238 | antisense | SEQ ID NO: 1239 | sense | SEQ ID NO: 1240 | antisense |
| SEQ ID NO: 1241 | sense | SEQ ID NO: 1242 | antisense | SEQ ID NO: 1243 | sense | SEQ ID NO: 1244 | antisense |
| SEQ ID NO: 1245 | sense | SEQ ID NO: 1246 | antisense | SEQ ID NO: 1247 | sense | SEQ ID NO: 1248 | antisense |
| SEQ ID NO: 1249 | sense | SEQ ID NO: 1250 | antisense | SEQ ID NO: 1251 | sense | SEQ ID NO: 1252 | antisense |
| SEQ ID NO: 1253 | sense | SEQ ID NO: 1254 | antisense | SEQ ID NO: 1255 | sense | SEQ ID NO: 1256 | antisense |
| SEQ ID NO: 1257 | sense | SEQ ID NO: 1258 | antisense | SEQ ID NO: 1259 | sense | SEQ ID NO: 1260 | antisense |
| SEQ ID NO: 1261 | sense | SEQ ID NO: 1262 | antisense | SEQ ID NO: 1263 | sense | SEQ ID NO: 1264 | antisense |
| SEQ ID NO: 1265 | sense | SEQ ID NO: 1266 | antisense | SEQ ID NO: 1267 | sense | SEQ ID NO: 1268 | antisense |
| SEQ ID NO: 1269 | sense | SEQ ID NO: 1270 | antisense | SEQ ID NO: 1271 | sense | SEQ ID NO: 1272 | antisense |
| SEQ ID NO: 1273 | sense | SEQ ID NO: 1274 | antisense | SEQ ID NO: 1275 | sense | SEQ ID NO: 1276 | antisense |
| SEQ ID NO: 1277 | sense | SEQ ID NO: 1278 | antisense | SEQ ID NO: 1279 | sense | SEQ ID NO: 1280 | antisense |
| SEQ ID NO: 1281 | sense | SEQ ID NO: 1282 | antisense | SEQ ID NO: 1283 | sense | SEQ ID NO: 1284 | antisense |
| SEQ ID NO: 1285 | sense | SEQ ID NO: 1286 | antisense | SEQ ID NO: 1287 | sense | SEQ ID NO: 1288 | antisense |
| SEQ ID NO: 1289 | sense | SEQ ID NO: 1290 | antisense | SEQ ID NO: 1291 | sense | SEQ ID NO: 1292 | antisense |
| SEQ ID NO: 1293 | sense | SEQ ID NO: 1294 | antisense | SEQ ID NO: 1295 | sense | SEQ ID NO: 1296 | antisense |
| SEQ ID NO: 1297 | sense | SEQ ID NO: 1298 | antisense | SEQ ID NO: 1299 | sense | SEQ ID NO: 1300 | antisense |
| SEQ ID NO: 1301 | sense | SEQ ID NO: 1302 | antisense | SEQ ID NO: 1303 | sense | SEQ ID NO: 1304 | antisense |
| SEQ ID NO: 1305 | sense | SEQ ID NO: 1306 | antisense | SEQ ID NO: 1307 | sense | SEQ ID NO: 1308 | antisense |
| SEQ ID NO: 1309 | sense | SEQ ID NO: 1310 | antisense | SEQ ID NO: 1311 | sense | SEQ ID NO: 1312 | antisense |
| SEQ ID NO: 1313 | sense | SEQ ID NO: 1314 | antisense | SEQ ID NO: 1315 | sense | SEQ ID NO: 1316 | antisense |
| SEQ ID NO: 1317 | sense | SEQ ID NO: 1318 | antisense | SEQ ID NO: 1319 | sense | SEQ ID NO: 1320 | antisense |
| SEQ ID NO: 1321 | sense | SEQ ID NO: 1322 | antisense | SEQ ID NO: 1323 | sense | SEQ ID NO: 1324 | antisense |
| SEQ ID NO: 1325 | sense | SEQ ID NO: 1326 | antisense | SEQ ID NO: 1327 | sense | SEQ ID NO: 1328 | antisense |
| SEQ ID NO: 1329 | sense | SEQ ID NO: 1330 | antisense | SEQ ID NO: 1331 | sense | SEQ ID NO: 1332 | antisense |
| SEQ ID NO: 1333 | sense | SEQ ID NO: 1334 | antisense | SEQ ID NO: 1335 | sense | SEQ ID NO: 1336 | antisense |

TABLE 6-continued

Human COL1A1 iRNA Sequences Designed on the Basis of the Human COL1A1 Transcript NM_000088.3
(SEQ ID NO: 172) that are Cross-Reactive with Mouse Col1a1 Transcript NM_007742.3 (SEQ ID NO: 173)

| Sense and Corresponding Antisense Duplexes | | | | Sense and Corresponding Antisense Duplexes | | | |
|---|---|---|---|---|---|---|---|
| Sense Strand | | Corresponding Antisense Strand | | Sense Strand | | Corresponding Antisense Strand | |
| SEQ ID NO: 1337 | sense | SEQ ID NO: 1338 | antisense | SEQ ID NO: 1339 | sense | SEQ ID NO: 1340 | antisense |
| SEQ ID NO: 1341 | sense | SEQ ID NO: 1342 | antisense | SEQ ID NO: 1343 | sense | SEQ ID NO: 1344 | antisense |
| SEQ ID NO: 1345 | sense | SEQ ID NO: 1346 | antisense | SEQ ID NO: 1347 | sense | SEQ ID NO: 1348 | antisense |
| SEQ ID NO: 1349 | sense | SEQ ID NO: 1350 | antisense | SEQ ID NO: 1351 | sense | SEQ ID NO: 1352 | antisense |
| SEQ ID NO: 1353 | sense | SEQ ID NO: 1354 | antisense | SEQ ID NO: 1355 | sense | SEQ ID NO: 1356 | antisense |
| SEQ ID NO: 1357 | sense | SEQ ID NO: 1358 | antisense | SEQ ID NO: 1359 | sense | SEQ ID NO: 1360 | antisense |
| SEQ ID NO: 1361 | sense | SEQ ID NO: 1362 | antisense | SEQ ID NO: 1363 | sense | SEQ ID NO: 1364 | antisense |
| SEQ ID NO: 1365 | sense | SEQ ID NO: 1366 | antisense | SEQ ID NO: 1367 | sense | SEQ ID NO: 1368 | antisense |
| SEQ ID NO: 1369 | sense | SEQ ID NO: 1370 | antisense | SEQ ID NO: 1371 | sense | SEQ ID NO: 1372 | antisense |
| SEQ ID NO: 1373 | sense | SEQ ID NO: 1374 | antisense | SEQ ID NO: 1375 | sense | SEQ ID NO: 1376 | antisense |
| SEQ ID NO: 1377 | sense | SEQ ID NO: 1378 | antisense | SEQ ID NO: 1379 | sense | SEQ ID NO: 1380 | antisense |
| SEQ ID NO: 1381 | sense | SEQ ID NO: 1382 | antisense | SEQ ID NO: 1383 | sense | SEQ ID NO: 1384 | antisense |
| SEQ ID NO: 1385 | sense | SEQ ID NO: 1386 | antisense | SEQ ID NO: 1387 | sense | SEQ ID NO: 1388 | antisense |
| SEQ ID NO: 1389 | sense | SEQ ID NO: 1390 | antisense | SEQ ID NO: 1391 | sense | SEQ ID NO: 1392 | antisense |
| SEQ ID NO: 1393 | sense | SEQ ID NO: 1394 | antisense | SEQ ID NO: 1395 | sense | SEQ ID NO: 1396 | antisense |
| SEQ ID NO: 1397 | sense | SEQ ID NO: 1398 | antisense | SEQ ID NO: 1399 | sense | SEQ ID NO: 1400 | antisense |
| SEQ ID NO: 1401 | sense | SEQ ID NO: 1402 | antisense | SEQ ID NO: 1403 | sense | SEQ ID NO: 1404 | antisense |
| SEQ ID NO: 1405 | sense | SEQ ID NO: 1406 | antisense | SEQ ID NO: 1407 | sense | SEQ ID NO: 1408 | antisense |
| SEQ ID NO: 1409 | sense | SEQ ID NO: 1410 | antisense | SEQ ID NO: 1411 | sense | SEQ ID NO: 1412 | antisense |
| SEQ ID NO: 1413 | sense | SEQ ID NO: 1414 | antisense | SEQ ID NO: 1415 | sense | SEQ ID NO: 1416 | antisense |
| SEQ ID NO: 1417 | sense | SEQ ID NO: 1418 | antisense | SEQ ID NO: 1419 | sense | SEQ ID NO: 1420 | antisense |
| SEQ ID NO: 1421 | sense | SEQ ID NO: 1422 | antisense | SEQ ID NO: 1423 | sense | SEQ ID NO: 1424 | antisense |
| SEQ ID NO: 1425 | sense | SEQ ID NO: 1426 | antisense | SEQ ID NO: 1427 | sense | SEQ ID NO: 1428 | antisense |
| SEQ ID NO: 1429 | sense | SEQ ID NO: 1430 | antisense | SEQ ID NO: 1431 | sense | SEQ ID NO: 1432 | antisense |
| SEQ ID NO: 1433 | sense | SEQ ID NO: 1434 | antisense | SEQ ID NO: 1435 | sense | SEQ ID NO: 1436 | antisense |
| SEQ ID NO: 1437 | sense | SEQ ID NO: 1438 | antisense | SEQ ID NO: 1439 | sense | SEQ ID NO: 1440 | antisense |
| SEQ ID NO: 1441 | sense | SEQ ID NO: 1442 | antisense | SEQ ID NO: 1443 | sense | SEQ ID NO: 1444 | antisense |
| SEQ ID NO: 1445 | sense | SEQ ID NO: 1446 | antisense | SEQ ID NO: 1447 | sense | SEQ ID NO: 1448 | antisense |
| SEQ ID NO: 1449 | sense | SEQ ID NO: 1450 | antisense | SEQ ID NO: 1451 | sense | SEQ ID NO: 1452 | antisense |
| SEQ ID NO: 1453 | sense | SEQ ID NO: 1454 | antisense | SEQ ID NO: 1455 | sense | SEQ ID NO: 1456 | antisense |
| SEQ ID NO: 1457 | sense | SEQ ID NO: 1458 | antisense | SEQ ID NO: 1459 | sense | SEQ ID NO: 1460 | antisense |
| SEQ ID NO: 1461 | sense | SEQ ID NO: 1462 | antisense | SEQ ID NO: 1463 | sense | SEQ ID NO: 1464 | antisense |
| SEQ ID NO: 1465 | sense | SEQ ID NO: 1466 | antisense | SEQ ID NO: 1467 | sense | SEQ ID NO: 1468 | antisense |
| SEQ ID NO: 1469 | sense | SEQ ID NO: 1470 | antisense | SEQ ID NO: 1471 | sense | SEQ ID NO: 1472 | antisense |
| SEQ ID NO: 1473 | sense | SEQ ID NO: 1474 | antisense | SEQ ID NO: 1475 | sense | SEQ ID NO: 1476 | antisense |
| SEQ ID NO: 1477 | sense | SEQ ID NO: 1478 | antisense | SEQ ID NO: 1479 | sense | SEQ ID NO: 1480 | antisense |
| SEQ ID NO: 1481 | sense | SEQ ID NO: 1482 | antisense | SEQ ID NO: 1483 | sense | SEQ ID NO: 1484 | antisense |
| SEQ ID NO: 1485 | sense | SEQ ID NO: 1486 | antisense | SEQ ID NO: 1487 | sense | SEQ ID NO: 1488 | antisense |
| SEQ ID NO: 1489 | sense | SEQ ID NO: 1490 | antisense | SEQ ID NO: 1491 | sense | SEQ ID NO: 1492 | antisense |
| SEQ ID NO: 1493 | sense | SEQ ID NO: 1494 | antisense | SEQ ID NO: 1495 | sense | SEQ ID NO: 1496 | antisense |
| SEQ ID NO: 1497 | sense | SEQ ID NO: 1498 | antisense | SEQ ID NO: 1499 | sense | SEQ ID NO: 1500 | antisense |
| SEQ ID NO: 1501 | sense | SEQ ID NO: 1502 | antisense | SEQ ID NO: 1503 | sense | SEQ ID NO: 1504 | antisense |
| SEQ ID NO: 1505 | sense | SEQ ID NO: 1506 | antisense | SEQ ID NO: 1507 | sense | SEQ ID NO: 1508 | antisense |
| SEQ ID NO: 1509 | sense | SEQ ID NO: 1510 | antisense | SEQ ID NO: 1511 | sense | SEQ ID NO: 1512 | antisense |
| SEQ ID NO: 1513 | sense | SEQ ID NO: 1514 | antisense | SEQ ID NO: 1515 | sense | SEQ ID NO: 1516 | antisense |
| SEQ ID NO: 1517 | sense | SEQ ID NO: 1518 | antisense | SEQ ID NO: 1519 | sense | SEQ ID NO: 1520 | antisense |
| SEQ ID NO: 1521 | sense | SEQ ID NO: 1522 | antisense | SEQ ID NO: 1523 | sense | SEQ ID NO: 1524 | antisense |
| SEQ ID NO: 1525 | sense | SEQ ID NO: 1526 | antisense | SEQ ID NO: 1527 | sense | SEQ ID NO: 1528 | antisense |
| SEQ ID NO: 1529 | sense | SEQ ID NO: 1530 | antisense | SEQ ID NO: 1531 | sense | SEQ ID NO: 1532 | antisense |
| SEQ ID NO: 1533 | sense | SEQ ID NO: 1534 | antisense | SEQ ID NO: 1535 | sense | SEQ ID NO: 1536 | antisense |
| SEQ ID NO: 1537 | sense | SEQ ID NO: 1538 | antisense | SEQ ID NO: 1539 | sense | SEQ ID NO: 1540 | antisense |
| SEQ ID NO: 1541 | sense | SEQ ID NO: 1542 | antisense | SEQ ID NO: 1543 | sense | SEQ ID NO: 1544 | antisense |
| SEQ ID NO: 1545 | sense | SEQ ID NO: 1546 | antisense | SEQ ID NO: 1547 | sense | SEQ ID NO: 1548 | antisense |
| SEQ ID NO: 1549 | sense | SEQ ID NO: 1550 | antisense | SEQ ID NO: 1551 | sense | SEQ ID NO: 1552 | antisense |
| SEQ ID NO: 1553 | sense | SEQ ID NO: 1554 | antisense | SEQ ID NO: 1555 | sense | SEQ ID NO: 1556 | antisense |
| SEQ ID NO: 1557 | sense | SEQ ID NO: 1558 | antisense | SEQ ID NO: 1559 | sense | SEQ ID NO: 1560 | antisense |
| SEQ ID NO: 1561 | sense | SEQ ID NO: 1562 | antisense | SEQ ID NO: 1563 | sense | SEQ ID NO: 1564 | antisense |
| SEQ ID NO: 1565 | sense | SEQ ID NO: 1566 | antisense | SEQ ID NO: 1567 | sense | SEQ ID NO: 1568 | antisense |
| SEQ ID NO: 1569 | sense | SEQ ID NO: 1570 | antisense | SEQ ID NO: 1571 | sense | SEQ ID NO: 1572 | antisense |
| SEQ ID NO: 1573 | sense | SEQ ID NO: 1574 | antisense | SEQ ID NO: 1575 | sense | SEQ ID NO: 1576 | antisense |
| SEQ ID NO: 1577 | sense | SEQ ID NO: 1578 | antisense | SEQ ID NO: 1579 | sense | SEQ ID NO: 1580 | antisense |
| SEQ ID NO: 1581 | sense | SEQ ID NO: 1582 | antisense | SEQ ID NO: 1583 | sense | SEQ ID NO: 1584 | antisense |
| SEQ ID NO: 1585 | sense | SEQ ID NO: 1586 | antisense | SEQ ID NO: 1587 | sense | SEQ ID NO: 1588 | antisense |
| SEQ ID NO: 1589 | sense | SEQ ID NO: 1590 | antisense | SEQ ID NO: 1591 | sense | SEQ ID NO: 1592 | antisense |
| SEQ ID NO: 1593 | sense | SEQ ID NO: 1594 | antisense | SEQ ID NO: 1595 | sense | SEQ ID NO: 1596 | antisense |
| SEQ ID NO: 1597 | sense | SEQ ID NO: 1598 | antisense | SEQ ID NO: 1599 | sense | SEQ ID NO: 1600 | antisense |
| SEQ ID NO: 1601 | sense | SEQ ID NO: 1600 | antisense | SEQ ID NO: 1603 | sense | SEQ ID NO: 1604 | antisense |
| SEQ ID NO: 1605 | sense | SEQ ID NO: 1604 | antisense | SEQ ID NO: 1607 | sense | SEQ ID NO: 1608 | antisense |
| SEQ ID NO: 1609 | sense | SEQ ID NO: 1610 | antisense | SEQ ID NO: 1611 | sense | SEQ ID NO: 1612 | antisense |
| SEQ ID NO: 1613 | sense | SEQ ID NO: 1614 | antisense | SEQ ID NO: 1615 | sense | SEQ ID NO: 1616 | antisense |
| SEQ ID NO: 1617 | sense | SEQ ID NO: 1618 | antisense | SEQ ID NO: 1619 | sense | SEQ ID NO: 1620 | antisense |
| SEQ ID NO: 1621 | sense | SEQ ID NO: 1622 | antisense | SEQ ID NO: 1623 | sense | SEQ ID NO: 1624 | antisense |

TABLE 6-continued

Human COL1A1 iRNA Sequences Designed on the Basis of the Human COL1A1 Transcript NM_000088.3
(SEQ ID NO: 172) that are Cross-Reactive with Mouse Col1a1 Transcript NM_007742.3 (SEQ ID NO: 173)

| Sense and Corresponding Antisense Duplexes | | | | Sense and Corresponding Antisense Duplexes | | | |
|---|---|---|---|---|---|---|---|
| Sense Strand | | Corresponding Anti sense Strand | | Sense Strand | | Corresponding Antisense Strand | |
| SEQ ID NO: 1625 | sense | SEQ ID NO: 1626 | antisense | SEQ ID NO: 1627 | sense | SEQ ID NO: 1628 | antisense |
| SEQ ID NO: 1629 | sense | SEQ ID NO: 1630 | antisense | SEQ ID NO: 1631 | sense | SEQ ID NO: 1632 | antisense |
| SEQ ID NO: 1633 | sense | SEQ ID NO: 1634 | antisense | SEQ ID NO: 1635 | sense | SEQ ID NO: 1636 | antisense |
| SEQ ID NO: 1637 | sense | SEQ ID NO: 1638 | antisense | SEQ ID NO: 1639 | sense | SEQ ID NO: 1640 | antisense |
| SEQ ID NO: 1641 | sense | SEQ ID NO: 1642 | antisense | SEQ ID NO: 1643 | sense | SEQ ID NO: 1644 | antisense |
| SEQ ID NO: 1645 | sense | SEQ ID NO: 1646 | antisense | SEQ ID NO: 1647 | sense | SEQ ID NO: 1648 | antisense |
| SEQ ID NO: 1649 | sense | SEQ ID NO: 1650 | antisense | SEQ ID NO: 1651 | sense | SEQ ID NO: 1652 | antisense |
| SEQ ID NO: 1653 | sense | SEQ ID NO: 1654 | antisense | SEQ ID NO: 1655 | sense | SEQ ID NO: 1656 | antisense |
| SEQ ID NO: 1657 | sense | SEQ ID NO: 1658 | antisense | SEQ ID NO: 1659 | sense | SEQ ID NO: 1660 | antisense |
| SEQ ID NO: 1661 | sense | SEQ ID NO: 1662 | antisense | SEQ ID NO: 1663 | sense | SEQ ID NO: 1664 | antisense |
| SEQ ID NO: 1665 | sense | SEQ ID NO: 1666 | antisense | SEQ ID NO: 1667 | sense | SEQ ID NO: 1668 | antisense |
| SEQ ID NO: 1669 | sense | SEQ ID NO: 1670 | antisense | SEQ ID NO: 1671 | sense | SEQ ID NO: 1672 | antisense |
| SEQ ID NO: 1673 | sense | SEQ ID NO: 1674 | antisense | SEQ ID NO: 1675 | sense | SEQ ID NO: 1676 | antisense |
| SEQ ID NO: 1677 | sense | SEQ ID NO: 1678 | antisense | SEQ ID NO: 1679 | sense | SEQ ID NO: 1680 | antisense |
| SEQ ID NO: 1681 | sense | SEQ ID NO: 1682 | antisense | SEQ ID NO: 1683 | sense | SEQ ID NO: 1684 | antisense |
| SEQ ID NO: 1685 | sense | SEQ ID NO: 1686 | antisense | SEQ ID NO: 1687 | sense | SEQ ID NO: 1688 | antisense |
| SEQ ID NO: 1689 | sense | SEQ ID NO: 1690 | antisense | SEQ ID NO: 1691 | sense | SEQ ID NO: 1692 | antisense |
| SEQ ID NO: 1693 | sense | SEQ ID NO: 1694 | antisense | SEQ ID NO: 1695 | sense | SEQ ID NO: 1696 | antisense |
| SEQ ID NO: 1697 | sense | SEQ ID NO: 1698 | antisense | SEQ ID NO: 1699 | sense | SEQ ID NO: 1700 | antisense |
| SEQ ID NO: 1701 | sense | SEQ ID NO: 1702 | antisense | SEQ ID NO: 1703 | sense | SEQ ID NO: 1704 | antisense |
| SEQ ID NO: 1705 | sense | SEQ ID NO: 1706 | antisense | SEQ ID NO: 1707 | sense | SEQ ID NO: 1708 | antisense |
| SEQ ID NO: 1709 | sense | SEQ ID NO: 1710 | antisense | SEQ ID NO: 1711 | sense | SEQ ID NO: 1712 | antisense |
| SEQ ID NO: 1713 | sense | SEQ ID NO: 1714 | antisense | SEQ ID NO: 1715 | sense | SEQ ID NO: 1716 | antisense |
| SEQ ID NO: 1717 | sense | SEQ ID NO: 1718 | antisense | SEQ ID NO: 1719 | sense | SEQ ID NO: 1720 | antisense |
| SEQ ID NO: 1721 | sense | SEQ ID NO: 1722 | antisense | SEQ ID NO: 1723 | sense | SEQ ID NO: 1724 | antisense |
| SEQ ID NO: 1725 | sense | SEQ ID NO: 1726 | antisense | SEQ ID NO: 1727 | sense | SEQ ID NO: 1728 | antisense |
| SEQ ID NO: 1729 | sense | SEQ ID NO: 1730 | antisense | SEQ ID NO: 1731 | sense | SEQ ID NO: 1732 | antisense |
| SEQ ID NO: 1733 | sense | SEQ ID NO: 1734 | antisense | SEQ ID NO: 1735 | sense | SEQ ID NO: 1736 | antisense |
| SEQ ID NO: 1737 | sense | SEQ ID NO: 1738 | antisense | SEQ ID NO: 1739 | sense | SEQ ID NO: 1740 | antisense |
| SEQ ID NO: 1741 | sense | SEQ ID NO: 1742 | antisense | SEQ ID NO: 1743 | sense | SEQ ID NO: 1744 | antisense |
| SEQ ID NO: 1745 | sense | SEQ ID NO: 1746 | antisense | SEQ ID NO: 1747 | sense | SEQ ID NO: 1748 | antisense |
| SEQ ID NO: 1749 | sense | SEQ ID NO: 1750 | antisense | SEQ ID NO: 1751 | sense | SEQ ID NO: 1752 | antisense |
| SEQ ID NO: 1753 | sense | SEQ ID NO: 1754 | antisense | SEQ ID NO: 1755 | sense | SEQ ID NO: 1756 | antisense |
| SEQ ID NO: 1757 | sense | SEQ ID NO: 1758 | antisense | SEQ ID NO: 1759 | sense | SEQ ID NO: 1760 | antisense |
| SEQ ID NO: 1761 | sense | SEQ ID NO: 1762 | antisense | SEQ ID NO: 1763 | sense | SEQ ID NO: 1764 | antisense |
| SEQ ID NO: 1765 | sense | SEQ ID NO: 1766 | antisense | SEQ ID NO: 1767 | sense | SEQ ID NO: 1768 | antisense |
| SEQ ID NO: 1769 | sense | SEQ ID NO: 1770 | antisense | SEQ ID NO: 1771 | sense | SEQ ID NO: 1772 | antisense |
| SEQ ID NO: 1773 | sense | SEQ ID NO: 1774 | antisense | SEQ ID NO: 1775 | sense | SEQ ID NO: 1776 | antisense |
| SEQ ID NO: 1777 | sense | SEQ ID NO: 1778 | antisense | SEQ ID NO: 1779 | sense | SEQ ID NO: 1780 | antisense |
| SEQ ID NO: 1781 | sense | SEQ ID NO: 1782 | antisense | SEQ ID NO: 1783 | sense | SEQ ID NO: 1784 | antisense |
| SEQ ID NO: 1785 | sense | SEQ ID NO: 1786 | antisense | SEQ ID NO: 1787 | sense | SEQ ID NO: 1788 | antisense |
| SEQ ID NO: 1789 | sense | SEQ ID NO: 1790 | antisense | SEQ ID NO: 1791 | sense | SEQ ID NO: 1792 | antisense |
| SEQ ID NO: 1793 | sense | SEQ ID NO: 1794 | antisense | SEQ ID NO: 1795 | sense | SEQ ID NO: 1796 | antisense |
| SEQ ID NO: 1797 | sense | SEQ ID NO: 1798 | antisense | SEQ ID NO: 1799 | sense | SEQ ID NO: 1800 | antisense |
| SEQ ID NO: 1801 | sense | SEQ ID NO: 1802 | antisense | SEQ ID NO: 1803 | sense | SEQ ID NO: 1804 | antisense |
| SEQ ID NO: 1805 | sense | SEQ ID NO: 1806 | antisense | SEQ ID NO: 1807 | sense | SEQ ID NO: 1808 | antisense |
| SEQ ID NO: 1809 | sense | SEQ ID NO: 1810 | antisense | SEQ ID NO: 1811 | sense | SEQ ID NO: 1812 | antisense |
| SEQ ID NO: 1813 | sense | SEQ ID NO: 1814 | antisense | SEQ ID NO: 1815 | sense | SEQ ID NO: 1816 | antisense |
| SEQ ID NO: 1817 | sense | SEQ ID NO: 1818 | antisense | SEQ ID NO: 1819 | sense | SEQ ID NO: 1820 | antisense |
| SEQ ID NO: 1821 | sense | SEQ ID NO: 1822 | antisense | SEQ ID NO: 1823 | sense | SEQ ID NO: 1824 | antisense |
| SEQ ID NO: 1825 | sense | SEQ ID NO: 1826 | antisense | SEQ ID NO: 1827 | sense | SEQ ID NO: 1828 | antisense |
| SEQ ID NO: 1829 | sense | SEQ ID NO: 1830 | antisense | SEQ ID NO: 1831 | sense | SEQ ID NO: 1832 | antisense |
| SEQ ID NO: 1833 | sense | SEQ ID NO: 1834 | antisense | SEQ ID NO: 1835 | sense | SEQ ID NO: 1836 | antisense |
| SEQ ID NO: 1837 | sense | SEQ ID NO: 1838 | antisense | SEQ ID NO: 1839 | sense | SEQ ID NO: 1840 | antisense |
| SEQ ID NO: 1841 | sense | SEQ ID NO: 1842 | antisense | SEQ ID NO: 1843 | sense | SEQ ID NO: 1844 | antisense |
| SEQ ID NO: 1845 | sense | SEQ ID NO: 1846 | antisense | SEQ ID NO: 1847 | sense | SEQ ID NO: 1848 | antisense |
| SEQ ID NO: 1849 | sense | SEQ ID NO: 1850 | antisense | SEQ ID NO: 1851 | sense | SEQ ID NO: 1852 | antisense |
| SEQ ID NO: 1853 | sense | SEQ ID NO: 1854 | antisense | SEQ ID NO: 1855 | sense | SEQ ID NO: 1856 | antisense |
| SEQ ID NO: 1857 | sense | SEQ ID NO: 1858 | antisense | SEQ ID NO: 1859 | sense | SEQ ID NO: 1860 | antisense |
| SEQ ID NO: 1861 | sense | SEQ ID NO: 1862 | antisense | SEQ ID NO: 1863 | sense | SEQ ID NO: 1864 | antisense |
| SEQ ID NO: 1865 | sense | SEQ ID NO: 1866 | antisense | SEQ ID NO: 1867 | sense | SEQ ID NO: 1868 | antisense |
| SEQ ID NO: 1869 | sense | SEQ ID NO: 1870 | antisense | SEQ ID NO: 1871 | sense | SEQ ID NO: 1872 | antisense |
| SEQ ID NO: 1873 | sense | SEQ ID NO: 1874 | antisense | SEQ ID NO: 1875 | sense | SEQ ID NO: 1876 | antisense |
| SEQ ID NO: 1877 | sense | SEQ ID NO: 1878 | antisense | SEQ ID NO: 1879 | sense | SEQ ID NO: 1880 | antisense |
| SEQ ID NO: 1881 | sense | SEQ ID NO: 1882 | antisense | SEQ ID NO: 1883 | sense | SEQ ID NO: 1884 | antisense |
| SEQ ID NO: 1885 | sense | SEQ ID NO: 1886 | antisense | SEQ ID NO: 1887 | sense | SEQ ID NO: 1888 | antisense |
| SEQ ID NO: 1889 | sense | SEQ ID NO: 1890 | antisense | SEQ ID NO: 1891 | sense | SEQ ID NO: 1892 | antisense |
| SEQ ID NO: 1893 | sense | SEQ ID NO: 1894 | antisense | SEQ ID NO: 1895 | sense | SEQ ID NO: 1896 | antisense |
| SEQ ID NO: 1897 | sense | SEQ ID NO: 1898 | antisense | SEQ ID NO: 1899 | sense | SEQ ID NO: 1900 | antisense |
| SEQ ID NO: 1901 | sense | SEQ ID NO: 1902 | antisense | SEQ ID NO: 1903 | sense | SEQ ID NO: 1904 | antisense |
| SEQ ID NO: 1905 | sense | SEQ ID NO: 1906 | antisense | SEQ ID NO: 1907 | sense | SEQ ID NO: 1908 | antisense |
| SEQ ID NO: 1909 | sense | SEQ ID NO: 1910 | antisense | SEQ ID NO: 1911 | sense | SEQ ID NO: 1912 | antisense |

TABLE 6-continued

Human COL1A1 iRNA Sequences Designed on the Basis of the Human COL1A1 Transcript NM_000088.3
(SEQ ID NO: 172) that are Cross-Reactive with Mouse Col1a1 Transcript NM_007742.3 (SEQ ID NO: 173)

| Sense and Corresponding Antisense Duplexes | | | | Sense and Corresponding Antisense Duplexes | | | |
|---|---|---|---|---|---|---|---|
| Sense Strand | | Corresponding Antisense Strand | | Sense Strand | | Corresponding Antisense Strand | |
| SEQ ID NO: 1913 | sense | SEQ ID NO: 1914 | antisense | SEQ ID NO: 1915 | sense | SEQ ID NO: 1916 | antisense |
| SEQ ID NO: 1917 | sense | SEQ ID NO: 1918 | antisense | SEQ ID NO: 1919 | sense | SEQ ID NO: 1920 | antisense |
| SEQ ID NO: 1921 | sense | SEQ ID NO: 1922 | antisense | SEQ ID NO: 1923 | sense | SEQ ID NO: 1924 | antisense |
| SEQ ID NO: 1925 | sense | SEQ ID NO: 1926 | antisense | SEQ ID NO: 1927 | sense | SEQ ID NO: 1928 | antisense |
| SEQ ID NO: 1929 | sense | SEQ ID NO: 1930 | antisense | SEQ ID NO: 1931 | sense | SEQ ID NO: 1932 | antisense |
| SEQ ID NO: 1933 | sense | SEQ ID NO: 1934 | antisense | SEQ ID NO: 1935 | sense | SEQ ID NO: 1936 | antisense |
| SEQ ID NO: 1937 | sense | SEQ ID NO: 1938 | antisense | SEQ ID NO: 1939 | sense | SEQ ID NO: 1940 | antisense |
| SEQ ID NO: 1941 | sense | SEQ ID NO: 1942 | antisense | SEQ ID NO: 1943 | sense | SEQ ID NO: 1944 | antisense |
| SEQ ID NO: 1945 | sense | SEQ ID NO: 1946 | antisense | SEQ ID NO: 1947 | sense | SEQ ID NO: 1948 | antisense |
| SEQ ID NO: 1949 | sense | SEQ ID NO: 1950 | antisense | SEQ ID NO: 1951 | sense | SEQ ID NO: 1952 | antisense |
| SEQ ID NO: 1953 | sense | SEQ ID NO: 1954 | antisense | SEQ ID NO: 1955 | sense | SEQ ID NO: 1956 | antisense |
| SEQ ID NO: 1957 | sense | SEQ ID NO: 1958 | antisense | SEQ ID NO: 1959 | sense | SEQ ID NO: 1960 | antisense |
| SEQ ID NO: 1961 | sense | SEQ ID NO: 1962 | antisense | SEQ ID NO: 1963 | sense | SEQ ID NO: 1964 | antisense |
| SEQ ID NO: 1965 | sense | SEQ ID NO: 1966 | antisense | SEQ ID NO: 1967 | sense | SEQ ID NO: 1968 | antisense |
| SEQ ID NO: 1969 | sense | SEQ ID NO: 1970 | antisense | SEQ ID NO: 1971 | sense | SEQ ID NO: 1972 | antisense |
| SEQ ID NO: 1973 | sense | SEQ ID NO: 1974 | antisense | SEQ ID NO: 1975 | sense | SEQ ID NO: 1976 | antisense |
| SEQ ID NO: 1977 | sense | SEQ ID NO: 1978 | antisense | SEQ ID NO: 1979 | sense | SEQ ID NO: 1980 | antisense |
| SEQ ID NO: 1981 | sense | SEQ ID NO: 1982 | antisense | SEQ ID NO: 1983 | sense | SEQ ID NO: 1984 | antisense |
| SEQ ID NO: 1985 | sense | SEQ ID NO: 1986 | antisense | SEQ ID NO: 1987 | sense | SEQ ID NO: 1988 | antisense |
| SEQ ID NO: 1989 | sense | SEQ ID NO: 1990 | antisense | SEQ ID NO: 1991 | sense | SEQ ID NO: 1992 | antisense |
| SEQ ID NO: 1993 | sense | SEQ ID NO: 1994 | antisense | SEQ ID NO: 1995 | sense | SEQ ID NO: 1996 | antisense |
| SEQ ID NO: 1997 | sense | SEQ ID NO: 1998 | antisense | SEQ ID NO: 1999 | sense | SEQ ID NO: 2000 | antisense |
| SEQ ID NO: 2001 | sense | SEQ ID NO: 2002 | antisense | SEQ ID NO: 2003 | sense | SEQ ID NO: 2004 | antisense |
| SEQ ID NO: 2005 | sense | SEQ ID NO: 2006 | antisense | SEQ ID NO: 2007 | sense | SEQ ID NO: 2008 | antisense |
| SEQ ID NO: 2009 | sense | SEQ ID NO: 2010 | antisense | SEQ ID NO: 2011 | sense | SEQ ID NO: 2012 | antisense |
| SEQ ID NO: 2013 | sense | SEQ ID NO: 2014 | antisense | SEQ ID NO: 2015 | sense | SEQ ID NO: 2016 | antisense |
| SEQ ID NO: 2017 | sense | SEQ ID NO: 2018 | antisense | SEQ ID NO: 2019 | sense | SEQ ID NO: 2020 | antisense |
| SEQ ID NO: 2021 | sense | SEQ ID NO: 2022 | antisense | SEQ ID NO: 2023 | sense | SEQ ID NO: 2024 | antisense |
| SEQ ID NO: 2025 | sense | SEQ ID NO: 2026 | antisense | SEQ ID NO: 2027 | sense | SEQ ID NO: 2028 | antisense |
| SEQ ID NO: 2029 | sense | SEQ ID NO: 2030 | antisense | SEQ ID NO: 2031 | sense | SEQ ID NO: 2032 | antisense |
| SEQ ID NO: 2033 | sense | SEQ ID NO: 2034 | antisense | SEQ ID NO: 2035 | sense | SEQ ID NO: 2036 | antisense |
| SEQ ID NO: 2037 | sense | SEQ ID NO: 2038 | antisense | SEQ ID NO: 2039 | sense | SEQ ID NO: 2040 | antisense |
| SEQ ID NO: 2041 | sense | SEQ ID NO: 2042 | antisense | SEQ ID NO: 2043 | sense | SEQ ID NO: 2044 | antisense |
| SEQ ID NO: 2045 | sense | SEQ ID NO: 2046 | antisense | SEQ ID NO: 2047 | sense | SEQ ID NO: 2048 | antisense |
| SEQ ID NO: 2049 | sense | SEQ ID NO: 2050 | antisense | SEQ ID NO: 2051 | sense | SEQ ID NO: 2052 | antisense |
| SEQ ID NO: 2053 | sense | SEQ ID NO: 2054 | antisense | SEQ ID NO: 2055 | sense | SEQ ID NO: 2056 | antisense |
| SEQ ID NO: 2057 | sense | SEQ ID NO: 2058 | antisense | SEQ ID NO: 2059 | sense | SEQ ID NO: 2060 | antisense |
| SEQ ID NO: 2061 | sense | SEQ ID NO: 2062 | antisense | SEQ ID NO: 2063 | sense | SEQ ID NO: 2064 | antisense |
| SEQ ID NO: 2065 | sense | SEQ ID NO: 2066 | antisense | SEQ ID NO: 2067 | sense | SEQ ID NO: 2068 | antisense |
| SEQ ID NO: 2069 | sense | SEQ ID NO: 2070 | antisense | SEQ ID NO: 2071 | sense | SEQ ID NO: 2072 | antisense |
| SEQ ID NO: 2073 | sense | SEQ ID NO: 2074 | antisense | SEQ ID NO: 2075 | sense | SEQ ID NO: 2076 | antisense |
| SEQ ID NO: 2077 | sense | SEQ ID NO: 2078 | antisense | SEQ ID NO: 2079 | sense | SEQ ID NO: 2080 | antisense |
| SEQ ID NO: 2081 | sense | SEQ ID NO: 2082 | antisense | SEQ ID NO: 2083 | sense | SEQ ID NO: 2084 | antisense |
| SEQ ID NO: 2085 | sense | SEQ ID NO: 2086 | antisense | SEQ ID NO: 2087 | sense | SEQ ID NO: 2088 | antisense |
| SEQ ID NO: 2089 | sense | SEQ ID NO: 2090 | antisense | SEQ ID NO: 2091 | sense | SEQ ID NO: 2092 | antisense |
| SEQ ID NO: 2093 | sense | SEQ ID NO: 2094 | antisense | SEQ ID NO: 2095 | sense | SEQ ID NO: 2096 | antisense |
| SEQ ID NO: 2097 | sense | SEQ ID NO: 2098 | antisense | SEQ ID NO: 2099 | sense | SEQ ID NO: 2100 | antisense |
| SEQ ID NO: 2101 | sense | SEQ ID NO: 2102 | antisense | SEQ ID NO: 2103 | sense | SEQ ID NO: 2104 | antisense |
| SEQ ID NO: 2105 | sense | SEQ ID NO: 2106 | antisense | SEQ ID NO: 2107 | sense | SEQ ID NO: 2108 | antisense |
| SEQ ID NO: 2109 | sense | SEQ ID NO: 2110 | antisense | SEQ ID NO: 2111 | sense | SEQ ID NO: 2112 | antisense |
| SEQ ID NO: 2113 | sense | SEQ ID NO: 2114 | antisense | SEQ ID NO: 2115 | sense | SEQ ID NO: 2116 | antisense |
| SEQ ID NO: 2117 | sense | SEQ ID NO: 2118 | antisense | SEQ ID NO: 2119 | sense | SEQ ID NO: 2120 | antisense |
| SEQ ID NO: 2121 | sense | SEQ ID NO: 2122 | antisense | SEQ ID NO: 2123 | sense | SEQ ID NO: 2124 | antisense |
| SEQ ID NO: 2125 | sense | SEQ ID NO: 2126 | antisense | SEQ ID NO: 2127 | sense | SEQ ID NO: 2128 | antisense |
| SEQ ID NO: 2129 | sense | SEQ ID NO: 2130 | antisense | SEQ ID NO: 2131 | sense | SEQ ID NO: 2132 | antisense |
| SEQ ID NO: 2133 | sense | SEQ ID NO: 2134 | antisense | SEQ ID NO: 2135 | sense | SEQ ID NO: 2136 | antisense |
| SEQ ID NO: 2137 | sense | SEQ ID NO: 2138 | antisense | SEQ ID NO: 2139 | sense | SEQ ID NO: 2140 | antisense |
| SEQ ID NO: 2141 | sense | SEQ ID NO: 2142 | antisense | SEQ ID NO: 2143 | sense | SEQ ID NO: 2144 | antisense |
| SEQ ID NO: 2145 | sense | SEQ ID NO: 2146 | antisense | SEQ ID NO: 2147 | sense | SEQ ID NO: 2148 | antisense |
| SEQ ID NO: 2149 | sense | SEQ ID NO: 2150 | antisense | SEQ ID NO: 2151 | sense | SEQ ID NO: 2152 | antisense |
| SEQ ID NO: 2153 | sense | SEQ ID NO: 2154 | antisense | SEQ ID NO: 2155 | sense | SEQ ID NO: 2156 | antisense |
| SEQ ID NO: 2157 | sense | SEQ ID NO: 2158 | antisense | SEQ ID NO: 2159 | sense | SEQ ID NO: 2160 | antisense |
| SEQ ID NO: 2161 | sense | SEQ ID NO: 2162 | antisense | SEQ ID NO: 2163 | sense | SEQ ID NO: 2164 | antisense |
| SEQ ID NO: 2165 | sense | SEQ ID NO: 2166 | antisense | SEQ ID NO: 2167 | sense | SEQ ID NO: 2168 | antisense |
| SEQ ID NO: 2169 | sense | SEQ ID NO: 2170 | antisense | SEQ ID NO: 2171 | sense | SEQ ID NO: 2172 | antisense |
| SEQ ID NO: 2173 | sense | SEQ ID NO: 2174 | antisense | SEQ ID NO: 2175 | sense | SEQ ID NO: 2176 | antisense |
| SEQ ID NO: 2177 | sense | SEQ ID NO: 2178 | antisense | SEQ ID NO: 2179 | sense | SEQ ID NO: 2180 | antisense |
| SEQ ID NO: 2181 | sense | SEQ ID NO: 2182 | antisense | SEQ ID NO: 2183 | sense | SEQ ID NO: 2184 | antisense |
| SEQ ID NO: 2185 | sense | SEQ ID NO: 2186 | antisense | SEQ ID NO: 2187 | sense | SEQ ID NO: 2188 | antisense |
| SEQ ID NO: 2189 | sense | SEQ ID NO: 2190 | antisense | SEQ ID NO: 2191 | sense | SEQ ID NO: 2192 | antisense |
| SEQ ID NO: 2193 | sense | SEQ ID NO: 2194 | antisense | SEQ ID NO: 2195 | sense | SEQ ID NO: 2196 | antisense |
| SEQ ID NO: 2197 | sense | SEQ ID NO: 2198 | antisense | SEQ ID NO: 2199 | sense | SEQ ID NO: 2200 | antisense |

TABLE 6-continued

Human COL1A1 iRNA Sequences Designed on the Basis of the Human COL1A1 Transcript NM_000088.3 (SEQ ID NO: 172) that are Cross-Reactive with Mouse Col1a1 Transcript NM_007742.3 (SEQ ID NO: 173)

| Sense and Corresponding Antisense Duplexes | | | | Sense and Corresponding Antisense Duplexes | | | |
|---|---|---|---|---|---|---|---|
| Sense Strand | | Corresponding Anti sense Strand | | Sense Strand | | Corresponding Antisense Strand | |
| SEQ ID NO: 2201 | sense | SEQ ID NO: 2202 | antisense | SEQ ID NO: 2203 | sense | SEQ ID NO: 2204 | antisense |
| SEQ ID NO: 2205 | sense | SEQ ID NO: 2206 | antisense | SEQ ID NO: 2207 | sense | SEQ ID NO: 2208 | antisense |
| SEQ ID NO: 2209 | sense | SEQ ID NO: 2210 | antisense | SEQ ID NO: 2211 | sense | SEQ ID NO: 2212 | antisense |
| SEQ ID NO: 2213 | sense | SEQ ID NO: 2214 | antisense | SEQ ID NO: 2215 | sense | SEQ ID NO: 2216 | antisense |
| SEQ ID NO: 2217 | sense | SEQ ID NO: 2218 | antisense | SEQ ID NO: 2219 | sense | SEQ ID NO: 2220 | antisense |
| SEQ ID NO: 2221 | sense | SEQ ID NO: 2222 | antisense | SEQ ID NO: 2223 | sense | SEQ ID NO: 2224 | antisense |
| SEQ ID NO: 2225 | sense | SEQ ID NO: 2226 | antisense | SEQ ID NO: 2227 | sense | SEQ ID NO: 2228 | antisense |
| SEQ ID NO: 2229 | sense | SEQ ID NO: 2230 | antisense | SEQ ID NO: 2231 | sense | SEQ ID NO: 2232 | antisense |
| SEQ ID NO: 2233 | sense | SEQ ID NO: 2234 | antisense | SEQ ID NO: 2235 | sense | SEQ ID NO: 2236 | antisense |
| SEQ ID NO: 2237 | sense | SEQ ID NO: 2238 | antisense | SEQ ID NO: 2239 | sense | SEQ ID NO: 2240 | antisense |
| SEQ ID NO: 2241 | sense | SEQ ID NO: 2242 | antisense | SEQ ID NO: 2243 | sense | SEQ ID NO: 2244 | antisense |
| SEQ ID NO: 2245 | sense | SEQ ID NO: 2246 | antisense | SEQ ID NO: 2247 | sense | SEQ ID NO: 2248 | antisense |
| SEQ ID NO: 2249 | sense | SEQ ID NO: 2250 | antisense | SEQ ID NO: 2251 | sense | SEQ ID NO: 2252 | antisense |
| SEQ ID NO: 2253 | sense | SEQ ID NO: 2254 | antisense | SEQ ID NO: 2255 | sense | SEQ ID NO: 2256 | antisense |
| SEQ ID NO: 2257 | sense | SEQ ID NO: 2258 | antisense | SEQ ID NO: 2259 | sense | SEQ ID NO: 2260 | antisense |
| SEQ ID NO: 2261 | sense | SEQ ID NO: 2262 | antisense | SEQ ID NO: 2263 | sense | SEQ ID NO: 2264 | antisense |
| SEQ ID NO: 2265 | sense | SEQ ID NO: 2266 | antisense | SEQ ID NO: 2267 | sense | SEQ ID NO: 2268 | antisense |
| SEQ ID NO: 2269 | sense | SEQ ID NO: 2270 | antisense | SEQ ID NO: 2271 | sense | SEQ ID NO: 2272 | antisense |
| SEQ ID NO: 2273 | sense | SEQ ID NO: 2274 | antisense | SEQ ID NO: 2275 | sense | SEQ ID NO: 2276 | antisense |
| SEQ ID NO: 2277 | sense | SEQ ID NO: 2278 | antisense | SEQ ID NO: 2279 | sense | SEQ ID NO: 2280 | antisense |
| SEQ ID NO: 2281 | sense | SEQ ID NO: 2282 | antisense | SEQ ID NO: 2283 | sense | SEQ ID NO: 2284 | antisense |
| SEQ ID NO: 2285 | sense | SEQ ID NO: 2286 | antisense | SEQ ID NO: 2287 | sense | SEQ ID NO: 2288 | antisense |
| SEQ ID NO: 2289 | sense | SEQ ID NO: 2290 | antisense | SEQ ID NO: 2291 | sense | SEQ ID NO: 2292 | antisense |
| SEQ ID NO: 2293 | sense | SEQ ID NO: 2294 | antisense | SEQ ID NO: 2295 | sense | SEQ ID NO: 2296 | antisense |
| SEQ ID NO: 2297 | sense | SEQ ID NO: 2298 | antisense | SEQ ID NO: 2299 | sense | SEQ ID NO: 2300 | antisense |
| SEQ ID NO: 2301 | sense | SEQ ID NO: 2302 | antisense | SEQ ID NO: 2303 | sense | SEQ ID NO: 2304 | antisense |
| SEQ ID NO: 2305 | sense | SEQ ID NO: 2306 | antisense | SEQ ID NO: 2307 | sense | SEQ ID NO: 2308 | antisense |
| SEQ ID NO: 2309 | sense | SEQ ID NO: 2310 | antisense | SEQ ID NO: 2311 | sense | SEQ ID NO: 2312 | antisense |
| SEQ ID NO: 2313 | sense | SEQ ID NO: 2314 | antisense | SEQ ID NO: 2315 | sense | SEQ ID NO: 2316 | antisense |
| SEQ ID NO: 2317 | sense | SEQ ID NO: 2318 | antisense | SEQ ID NO: 2319 | sense | SEQ ID NO: 2320 | antisense |
| SEQ ID NO: 2321 | sense | SEQ ID NO: 2322 | antisense | SEQ ID NO: 2323 | sense | SEQ ID NO: 2324 | antisense |
| SEQ ID NO: 2325 | sense | SEQ ID NO: 2326 | antisense | SEQ ID NO: 2327 | sense | SEQ ID NO: 2328 | antisense |
| SEQ ID NO: 2329 | sense | SEQ ID NO: 2330 | antisense | SEQ ID NO: 2331 | sense | SEQ ID NO: 2332 | antisense |
| SEQ ID NO: 2333 | sense | SEQ ID NO: 2334 | antisense | SEQ ID NO: 2335 | sense | SEQ ID NO: 2336 | antisense |
| SEQ ID NO: 2337 | sense | SEQ ID NO: 2338 | antisense | SEQ ID NO: 2339 | sense | SEQ ID NO: 2340 | antisense |
| SEQ ID NO: 2341 | sense | SEQ ID NO: 2343 | antisense | SEQ ID NO: 2343 | sense | SEQ ID NO: 2344 | antisense |
| SEQ ID NO: 2345 | sense | SEQ ID NO: 2346 | antisense | SEQ ID NO: 2347 | sense | SEQ ID NO: 2348 | antisense |
| SEQ ID NO: 2349 | sense | SEQ ID NO: 2350 | antisense | SEQ ID NO: 2351 | sense | SEQ ID NO: 2352 | antisense |
| SEQ ID NO: 2353 | sense | SEQ ID NO: 2354 | antisense | SEQ ID NO: 2355 | sense | SEQ ID NO: 2356 | antisense |
| SEQ ID NO: 2357 | sense | SEQ ID NO: 2358 | antisense | SEQ ID NO: 2359 | sense | SEQ ID NO: 2360 | antisense |
| SEQ ID NO: 2361 | sense | SEQ ID NO: 2362 | antisense | SEQ ID NO: 2363 | sense | SEQ ID NO: 2364 | antisense |
| SEQ ID NO: 2365 | sense | SEQ ID NO: 2366 | antisense | SEQ ID NO: 2367 | sense | SEQ ID NO: 2368 | antisense |
| SEQ ID NO: 2369 | sense | SEQ ID NO: 2370 | antisense | SEQ ID NO: 2371 | sense | SEQ ID NO: 2372 | antisense |
| SEQ ID NO: 2373 | sense | SEQ ID NO: 2374 | antisense | SEQ ID NO: 2375 | sense | SEQ ID NO: 2376 | antisense |
| SEQ ID NO: 2377 | sense | SEQ ID NO: 2378 | antisense | SEQ ID NO: 2379 | sense | SEQ ID NO: 2380 | antisense |
| SEQ ID NO: 2381 | sense | SEQ ID NO: 2382 | antisense | SEQ ID NO: 2383 | sense | SEQ ID NO: 2384 | antisense |
| SEQ ID NO: 2385 | sense | SEQ ID NO: 2386 | antisense | SEQ ID NO: 2387 | sense | SEQ ID NO: 2388 | antisense |
| SEQ ID NO: 2389 | sense | SEQ ID NO: 2390 | antisense | SEQ ID NO: 2391 | sense | SEQ ID NO: 2392 | antisense |
| SEQ ID NO: 2393 | sense | SEQ ID NO: 2393 | antisense | SEQ ID NO: 2395 | sense | SEQ ID NO: 2396 | antisense |
| SEQ ID NO: 2397 | sense | SEQ ID NO: 2398 | antisense | SEQ ID NO: 2399 | sense | SEQ ID NO: 2400 | antisense |
| SEQ ID NO: 2401 | sense | SEQ ID NO: 2402 | antisense | SEQ ID NO: 2403 | sense | SEQ ID NO: 2404 | antisense |
| SEQ ID NO: 2405 | sense | SEQ ID NO: 2406 | antisense | SEQ ID NO: 2407 | sense | SEQ ID NO: 2408 | antisense |
| SEQ ID NO: 2409 | sense | SEQ ID NO: 2410 | antisense | SEQ ID NO: 2411 | sense | SEQ ID NO: 2412 | antisense |
| SEQ ID NO: 2413 | sense | SEQ ID NO: 2414 | antisense | SEQ ID NO: 2415 | sense | SEQ ID NO: 2416 | antisense |
| SEQ ID NO: 2417 | sense | SEQ ID NO: 2418 | antisense | SEQ ID NO: 2419 | sense | SEQ ID NO: 2420 | antisense |
| SEQ ID NO: 2421 | sense | SEQ ID NO: 2422 | antisense | SEQ ID NO: 2423 | sense | SEQ ID NO: 2424 | antisense |
| SEQ ID NO: 2425 | sense | SEQ ID NO: 2426 | antisense | SEQ ID NO: 2427 | sense | SEQ ID NO: 2428 | antisense |
| SEQ ID NO: 2429 | sense | SEQ ID NO: 2430 | antisense | SEQ ID NO: 2431 | sense | SEQ ID NO: 2432 | antisense |
| SEQ ID NO: 2433 | sense | SEQ ID NO: 2434 | antisense | SEQ ID NO: 2435 | sense | SEQ ID NO: 2436 | antisense |
| SEQ ID NO: 2437 | sense | SEQ ID NO: 2438 | antisense | SEQ ID NO: 2439 | sense | SEQ ID NO: 2440 | antisense |
| SEQ ID NO: 2441 | sense | SEQ ID NO: 2442 | antisense | SEQ ID NO: 2443 | sense | SEQ ID NO: 2444 | antisense |
| SEQ ID NO: 2445 | sense | SEQ ID NO: 2446 | antisense | SEQ ID NO: 2447 | sense | SEQ ID NO: 2448 | antisense |
| SEQ ID NO: 2449 | sense | SEQ ID NO: 2450 | antisense | SEQ ID NO: 2451 | sense | SEQ ID NO: 2452 | antisense |
| SEQ ID NO: 2453 | sense | SEQ ID NO: 2454 | antisense | SEQ ID NO: 2455 | sense | SEQ ID NO: 2456 | antisense |
| SEQ ID NO: 2457 | sense | SEQ ID NO: 2458 | antisense | SEQ ID NO: 2459 | sense | SEQ ID NO: 2460 | antisense |
| SEQ ID NO: 2461 | sense | SEQ ID NO: 2462 | antisense | SEQ ID NO: 2463 | sense | SEQ ID NO: 2464 | antisense |
| SEQ ID NO: 2465 | sense | SEQ ID NO: 2466 | antisense | SEQ ID NO: 2467 | sense | SEQ ID NO: 2468 | antisense |
| SEQ ID NO: 2469 | sense | SEQ ID NO: 2470 | antisense | SEQ ID NO: 2471 | sense | SEQ ID NO: 2472 | antisense |
| SEQ ID NO: 2473 | sense | SEQ ID NO: 2474 | antisense | SEQ ID NO: 2475 | sense | SEQ ID NO: 2476 | antisense |
| SEQ ID NO: 2477 | sense | SEQ ID NO: 2478 | antisense | SEQ ID NO: 2479 | sense | SEQ ID NO: 2480 | antisense |
| SEQ ID NO: 2481 | sense | SEQ ID NO: 2482 | antisense | SEQ ID NO: 2483 | sense | SEQ ID NO: 2484 | antisense |
| SEQ ID NO: 2485 | sense | SEQ ID NO: 2486 | antisense | SEQ ID NO: 2487 | sense | SEQ ID NO: 2488 | antisense |

TABLE 6-continued

Human COL1A1 iRNA Sequences Designed on the Basis of the Human COL1A1 Transcript NM_000088.3
(SEQ ID NO: 172) that are Cross-Reactive with Mouse Col1a1 Transcript NM_007742.3 (SEQ ID NO: 173)

| Sense and Corresponding Antisense Duplexes | | | | Sense and Corresponding Antisense Duplexes | | | |
|---|---|---|---|---|---|---|---|
| Sense Strand | | Corresponding Anti sense Strand | | Sense Strand | | Corresponding Antisense Strand | |
| SEQ ID NO: 2489 | sense | SEQ ID NO: 2490 | antisense | SEQ ID NO: 2491 | sense | SEQ ID NO: 2492 | antisense |
| SEQ ID NO: 2493 | sense | SEQ ID NO: 2494 | antisense | SEQ ID NO: 2495 | sense | SEQ ID NO: 2496 | antisense |
| SEQ ID NO: 2497 | sense | SEQ ID NO: 2498 | antisense | SEQ ID NO: 2499 | sense | SEQ ID NO: 2500 | antisense |
| SEQ ID NO: 2501 | sense | SEQ ID NO: 2502 | antisense | SEQ ID NO: 2503 | sense | SEQ ID NO: 2504 | antisense |
| SEQ ID NO: 2505 | sense | SEQ ID NO: 2506 | antisense | SEQ ID NO: 2507 | sense | SEQ ID NO: 2508 | antisense |
| SEQ ID NO: 2509 | sense | SEQ ID NO: 2510 | antisense | SEQ ID NO: 2511 | sense | SEQ ID NO: 2512 | antisense |
| SEQ ID NO: 2513 | sense | SEQ ID NO: 2514 | antisense | SEQ ID NO: 2515 | sense | SEQ ID NO: 2516 | antisense |
| SEQ ID NO: 2517 | sense | SEQ ID NO: 2518 | antisense | SEQ ID NO: 2519 | sense | SEQ ID NO: 2520 | antisense |
| SEQ ID NO: 2521 | sense | SEQ ID NO: 2522 | antisense | SEQ ID NO: 2523 | sense | SEQ ID NO: 2524 | antisense |
| SEQ ID NO: 2525 | sense | SEQ ID NO: 2526 | antisense | SEQ ID NO: 2527 | sense | SEQ ID NO: 2528 | antisense |
| SEQ ID NO: 2529 | sense | SEQ ID NO: 2530 | antisense | SEQ ID NO: 2531 | sense | SEQ ID NO: 2532 | antisense |
| SEQ ID NO: 2533 | sense | SEQ ID NO: 2534 | antisense | SEQ ID NO: 2535 | sense | SEQ ID NO: 2536 | antisense |
| SEQ ID NO: 2537 | sense | SEQ ID NO: 2538 | antisense | SEQ ID NO: 2539 | sense | SEQ ID NO: 2540 | antisense |
| SEQ ID NO: 2541 | sense | SEQ ID NO: 2542 | antisense | SEQ ID NO: 2543 | sense | SEQ ID NO: 2544 | antisense |
| SEQ ID NO: 2545 | sense | SEQ ID NO: 2546 | antisense | SEQ ID NO: 2547 | sense | SEQ ID NO: 2548 | antisense |
| SEQ ID NO: 2549 | sense | SEQ ID NO: 2550 | antisense | SEQ ID NO: 2551 | sense | SEQ ID NO: 2552 | antisense |
| SEQ ID NO: 2553 | sense | SEQ ID NO: 2554 | antisense | SEQ ID NO: 2555 | sense | SEQ ID NO: 2556 | antisense |
| SEQ ID NO: 2557 | sense | SEQ ID NO: 2558 | antisense | SEQ ID NO: 2559 | sense | SEQ ID NO: 2560 | antisense |
| SEQ ID NO: 2561 | sense | SEQ ID NO: 2562 | antisense | SEQ ID NO: 2563 | sense | SEQ ID NO: 2564 | antisense |
| SEQ ID NO: 2565 | sense | SEQ ID NO: 2566 | antisense | SEQ ID NO: 2567 | sense | SEQ ID NO: 2568 | antisense |
| SEQ ID NO: 2569 | sense | SEQ ID NO: 2570 | antisense | SEQ ID NO: 2571 | sense | SEQ ID NO: 2572 | antisense |
| SEQ ID NO: 2573 | sense | SEQ ID NO: 2574 | antisense | SEQ ID NO: 2575 | sense | SEQ ID NO: 2576 | antisense |
| SEQ ID NO: 2577 | sense | SEQ ID NO: 2578 | antisense | SEQ ID NO: 2579 | sense | SEQ ID NO: 2580 | antisense |
| SEQ ID NO: 2581 | sense | SEQ ID NO: 2582 | antisense | SEQ ID NO: 2583 | sense | SEQ ID NO: 2584 | antisense |
| SEQ ID NO: 2585 | sense | SEQ ID NO: 2586 | antisense | SEQ ID NO: 2587 | sense | SEQ ID NO: 2588 | antisense |
| SEQ ID NO: 2589 | sense | SEQ ID NO: 2590 | antisense | SEQ ID NO: 2591 | sense | SEQ ID NO: 2592 | antisense |
| SEQ ID NO: 2593 | sense | SEQ ID NO: 2594 | antisense | SEQ ID NO: 2595 | sense | SEQ ID NO: 2596 | antisense |
| SEQ ID NO: 2597 | sense | SEQ ID NO: 2598 | antisense | SEQ ID NO: 2599 | sense | SEQ ID NO: 2600 | antisense |
| SEQ ID NO: 2601 | sense | SEQ ID NO: 2602 | antisense | SEQ ID NO: 2603 | sense | SEQ ID NO: 2604 | antisense |
| SEQ ID NO: 2605 | sense | SEQ ID NO: 2606 | antisense | SEQ ID NO: 2607 | sense | SEQ ID NO: 2608 | antisense |
| SEQ ID NO: 2609 | sense | SEQ ID NO: 2610 | antisense | SEQ ID NO: 2611 | sense | SEQ ID NO: 2612 | antisense |
| SEQ ID NO: 2613 | sense | SEQ ID NO: 2614 | antisense | SEQ ID NO: 2615 | sense | SEQ ID NO: 2616 | antisense |
| SEQ ID NO: 2617 | sense | SEQ ID NO: 2618 | antisense | SEQ ID NO: 2619 | sense | SEQ ID NO: 2620 | antisense |
| SEQ ID NO: 2621 | sense | SEQ ID NO: 2622 | antisense | SEQ ID NO: 2623 | sense | SEQ ID NO: 2624 | antisense |
| SEQ ID NO: 2625 | sense | SEQ ID NO: 2626 | antisense | SEQ ID NO: 2627 | sense | SEQ ID NO: 2628 | antisense |
| SEQ ID NO: 2629 | sense | SEQ ID NO: 2630 | antisense | SEQ ID NO: 2631 | sense | SEQ ID NO: 2632 | antisense |
| SEQ ID NO: 2633 | sense | SEQ ID NO: 2634 | antisense | SEQ ID NO: 2635 | sense | SEQ ID NO: 2636 | antisense |
| SEQ ID NO: 2637 | sense | SEQ ID NO: 2638 | antisense | SEQ ID NO: 2639 | sense | SEQ ID NO: 2640 | antisense |
| SEQ ID NO: 2641 | sense | SEQ ID NO: 2642 | antisense | SEQ ID NO: 2643 | sense | SEQ ID NO: 2644 | antisense |
| SEQ ID NO: 2645 | sense | SEQ ID NO: 2646 | antisense | SEQ ID NO: 2647 | sense | SEQ ID NO: 2648 | antisense |
| SEQ ID NO: 2649 | sense | SEQ ID NO: 2650 | antisense | SEQ ID NO: 2651 | sense | SEQ ID NO: 2652 | antisense |
| SEQ ID NO: 2653 | sense | SEQ ID NO: 2654 | antisense | SEQ ID NO: 2655 | sense | SEQ ID NO: 2656 | antisense |
| SEQ ID NO: 2657 | sense | SEQ ID NO: 2658 | antisense | SEQ ID NO: 2659 | sense | SEQ ID NO: 2660 | antisense |
| SEQ ID NO: 2661 | sense | SEQ ID NO: 2662 | antisense | SEQ ID NO: 2663 | sense | SEQ ID NO: 2664 | antisense |
| SEQ ID NO: 2665 | sense | SEQ ID NO: 2666 | antisense | SEQ ID NO: 2667 | sense | SEQ ID NO: 2668 | antisense |
| SEQ ID NO: 2669 | sense | SEQ ID NO: 2670 | antisense | SEQ ID NO: 2671 | sense | SEQ ID NO: 2672 | antisense |
| SEQ ID NO: 2673 | sense | SEQ ID NO: 2674 | antisense | SEQ ID NO: 2675 | sense | SEQ ID NO: 2676 | antisense |
| SEQ ID NO: 2677 | sense | SEQ ID NO: 2678 | antisense | SEQ ID NO: 2679 | sense | SEQ ID NO: 2680 | antisense |
| SEQ ID NO: 2681 | sense | SEQ ID NO: 2682 | antisense | SEQ ID NO: 2683 | sense | SEQ ID NO: 2684 | antisense |
| SEQ ID NO: 2685 | sense | SEQ ID NO: 2686 | antisense | SEQ ID NO: 2687 | sense | SEQ ID NO: 2688 | antisense |
| SEQ ID NO: 2689 | sense | SEQ ID NO: 2690 | antisense | SEQ ID NO: 2691 | sense | SEQ ID NO: 2692 | antisense |
| SEQ ID NO: 2693 | sense | SEQ ID NO: 2694 | antisense | SEQ ID NO: 2695 | sense | SEQ ID NO: 2696 | antisense |
| SEQ ID NO: 2697 | sense | SEQ ID NO: 2698 | antisense | SEQ ID NO: 2699 | sense | SEQ ID NO: 2700 | antisense |
| SEQ ID NO: 2701 | sense | SEQ ID NO: 2702 | antisense | SEQ ID NO: 2703 | sense | SEQ ID NO: 2704 | antisense |
| SEQ ID NO: 2705 | sense | SEQ ID NO: 2706 | antisense | SEQ ID NO: 2707 | sense | SEQ ID NO: 2708 | antisense |
| SEQ ID NO: 2709 | sense | SEQ ID NO: 2710 | antisense | SEQ ID NO: 2711 | sense | SEQ ID NO: 2712 | antisense |
| SEQ ID NO: 2713 | sense | SEQ ID NO: 2714 | antisense | SEQ ID NO: 2715 | sense | SEQ ID NO: 2716 | antisense |
| SEQ ID NO: 2717 | sense | SEQ ID NO: 2718 | antisense | SEQ ID NO: 2719 | sense | SEQ ID NO: 2720 | antisense |
| SEQ ID NO: 2721 | sense | SEQ ID NO: 2722 | antisense | SEQ ID NO: 2723 | sense | SEQ ID NO: 2724 | antisense |
| SEQ ID NO: 2725 | sense | SEQ ID NO: 2726 | antisense | SEQ ID NO: 2727 | sense | SEQ ID NO: 2728 | antisense |
| SEQ ID NO: 2729 | sense | SEQ ID NO: 2730 | antisense | SEQ ID NO: 2731 | sense | SEQ ID NO: 2732 | antisense |
| SEQ ID NO: 2733 | sense | SEQ ID NO: 2734 | antisense | SEQ ID NO: 2735 | sense | SEQ ID NO: 2736 | antisense |
| SEQ ID NO: 2737 | sense | SEQ ID NO: 2738 | antisense | SEQ ID NO: 2739 | sense | SEQ ID NO: 2740 | antisense |
| SEQ ID NO: 2741 | sense | SEQ ID NO: 2742 | antisense | SEQ ID NO: 2743 | sense | SEQ ID NO: 2744 | antisense |
| SEQ ID NO: 2745 | sense | SEQ ID NO: 2746 | antisense | SEQ ID NO: 2747 | sense | SEQ ID NO: 2748 | antisense |
| SEQ ID NO: 2749 | sense | SEQ ID NO: 2750 | antisense | SEQ ID NO: 2751 | sense | SEQ ID NO: 2752 | antisense |
| SEQ ID NO: 2753 | sense | SEQ ID NO: 2754 | antisense | SEQ ID NO: 2755 | sense | SEQ ID NO: 2756 | antisense |
| SEQ ID NO: 2757 | sense | SEQ ID NO: 2758 | antisense | SEQ ID NO: 2759 | sense | SEQ ID NO: 2760 | antisense |
| SEQ ID NO: 2761 | sense | SEQ ID NO: 2762 | antisense | SEQ ID NO: 2763 | sense | SEQ ID NO: 2764 | antisense |
| SEQ ID NO: 2765 | sense | SEQ ID NO: 2766 | antisense | SEQ ID NO: 2767 | sense | SEQ ID NO: 2768 | antisense |
| SEQ ID NO: 2769 | sense | SEQ ID NO: 2770 | antisense | SEQ ID NO: 2771 | sense | SEQ ID NO: 2772 | antisense |
| SEQ ID NO: 2773 | sense | SEQ ID NO: 2774 | antisense | SEQ ID NO: 2775 | sense | SEQ ID NO: 2776 | antisense |

TABLE 6-continued

Human COL1A1 iRNA Sequences Designed on the Basis of the Human COL1A1 Transcript NM_000088.3 (SEQ ID NO: 172) that are Cross-Reactive with Mouse Col1a1 Transcript NM_007742.3 (SEQ ID NO: 173)

| Sense and Corresponding Antisense Duplexes | | | | Sense and Corresponding Antisense Duplexes | | | |
|---|---|---|---|---|---|---|---|
| Sense Strand | | Corresponding Anti sense Strand | | Sense Strand | | Corresponding Antisense Strand | |
| SEQ ID NO: 2777 | sense | SEQ ID NO: 2778 | antisense | SEQ ID NO: 2779 | sense | SEQ ID NO: 2780 | antisense |
| SEQ ID NO: 2781 | sense | SEQ ID NO: 2782 | antisense | SEQ ID NO: 2783 | sense | SEQ ID NO: 2784 | antisense |
| SEQ ID NO: 2785 | sense | SEQ ID NO: 2786 | antisense | SEQ ID NO: 2787 | sense | SEQ ID NO: 2788 | antisense |
| SEQ ID NO: 2789 | sense | SEQ ID NO: 2790 | antisense | SEQ ID NO: 2791 | sense | SEQ ID NO: 2792 | antisense |

TABLE 7

Transforming growth factor beta iRNA sequences

| Sense and Corresponding Antisense Duplexes | | | | Sense and Corresponding Antisense Duplexes | | | |
|---|---|---|---|---|---|---|---|
| Sense Strand | | Corresponding Antisense Strand | | Sense Strand | | Corresponding Antisense Strand | |
| SEQ ID NO: 2793 | sense | SEQ ID NO: 2794 | antisense | SEQ ID NO: 2795 | sense | SEQ ID NO: 2796 | antisense |
| SEQ ID NO: 2797 | sense | SEQ ID NO: 2798 | antisense | SEQ ID NO: 2799 | sense | SEQ ID NO: 2800 | antisense |
| SEQ ID NO: 2801 | sense | SEQ ID NO: 2802 | antisense | SEQ ID NO: 2803 | sense | SEQ ID NO: 2804 | antisense |
| SEQ ID NO: 2805 | sense | SEQ ID NO: 2806 | antisense | SEQ ID NO: 2807 | sense | SEQ ID NO: 2808 | antisense |
| SEQ ID NO: 2809 | sense | SEQ ID NO: 2810 | antisense | SEQ ID NO: 2811 | sense | SEQ ID NO: 2812 | antisense |
| SEQ ID NO: 2813 | sense | SEQ ID NO: 2814 | antisense | SEQ ID NO: 2815 | sense | SEQ ID NO: 2816 | antisense |
| SEQ ID NO: 2817 | sense | SEQ ID NO: 2818 | antisense | SEQ ID NO: 2819 | sense | SEQ ID NO: 2820 | antisense |
| SEQ ID NO: 2821 | sense | SEQ ID NO: 2822 | antisense | SEQ ID NO: 2823 | sense | SEQ ID NO: 2824 | antisense |
| SEQ ID NO: 2825 | sense | SEQ ID NO: 2826 | antisense | SEQ ID NO: 2827 | sense | SEQ ID NO: 2828 | antisense |
| SEQ ID NO: 2829 | sense | SEQ ID NO: 2830 | antisense | SEQ ID NO: 2831 | sense | SEQ ID NO: 2832 | antisense |
| SEQ ID NO: 2833 | sense | SEQ ID NO: 2834 | antisense | SEQ ID NO: 2835 | sense | SEQ ID NO: 2836 | antisense |
| SEQ ID NO: 2837 | sense | SEQ ID NO: 2838 | antisense | SEQ ID NO: 2839 | sense | SEQ ID NO: 2840 | antisense |
| SEQ ID NO: 2841 | sense | SEQ ID NO: 2842 | antisense | SEQ ID NO: 2843 | sense | SEQ ID NO: 2844 | antisense |
| SEQ ID NO: 2845 | sense | SEQ ID NO: 2846 | antisense | SEQ ID NO: 2847 | sense | SEQ ID NO: 2848 | antisense |
| SEQ ID NO: 2849 | sense | SEQ ID NO: 2850 | antisense | SEQ ID NO: 2851 | sense | SEQ ID NO: 2852 | antisense |
| SEQ ID NO: 2853 | sense | SEQ ID NO: 2854 | antisense | SEQ ID NO: 2855 | sense | SEQ ID NO: 2856 | antisense |
| SEQ ID NO: 2857 | sense | SEQ ID NO: 2858 | antisense | SEQ ID NO: 2859 | sense | SEQ ID NO: 2860 | antisense |

TABLE 8

Commonly used liver fibrosis staging scores.

| Staging System | Fibrosis stages | Remark | |
|---|---|---|---|
| METAVIR Score | F0, F1, F2, F3, F4 | Best evaluated in HCV fibrosis | (The French METAVIR Cooperative Study Group 1994) |
| Knodell Score | F0, F1, F3, F4 | No intermediate stage | (Knodell 1981) |
| Desmet & Scheuer | Analogous to METAVIR | Recommended by German guidelines for the assessment of liver fibrosis | (Desmet 1994; Schirmacher 2004) |
| Batts & Ludwig | Similar to METAVIR | | (Batts 1995) |
| Ishak Score | F0, F1, F2, F3, F4, F5, F6 | | (Ishak 1995) |

Batts K P, Ludwig J. Chronic hepatitis. An update on terminology and reporting. Am J Surg Pathol 1995, 19 (12):1409-17.

Desmet V J, Gerber M, Hoofnagle J H, Manns M, Scheuer P J. Classification of chronic hepatitis: diagnosis, grading and staging. Hepatology 1994, 19(6):1513-20.

Ishak K, Baptista A, Bianchi L, Callea F, De Groote J, Gudat F, et al. Histological grading and staging of chronic hepatitis. J Hepatol 1995, 22(6):696-9.

Knodell R G, Ishak K G, Black W C, Chen T S, Craig R, Kaplowitz N, Kiernan T W, Wollman J. Formulation and application of a numerical scoring system for assessing histological activity in asymptomatic chronic active hepatitis. Hepatology 1981, 1(5):431-5.

Schirmacher P, Fleig W E, Dienes H P. (Biopsy diagnosis of chronic hepatitis). Z Gastroenterol 2004, 42(2):175-85.

TABLE 9

Common biomarkers of liver

| Index | Markers | Calculation | Interpretation | PPV/NPV (%) |
|---|---|---|---|---|
| *Direct surrogate markers* | | | | |
| MP3 | PIIINP, MMP-1 | 0.5901(logPIINP[ng/ml]) − 0.1749(logMMP-1[ng/ml]) | <0.3 ≈ F0-2<br>>0.4 ≈ F3-4<br><0.3 ≈ F0-1<br>>0.4 ≈ F2-4 | NPV = 95<br>PPV = 66<br>NPV = 75<br>PPV = 91 |
| ELF | PIIINP, HA | Proprietary | >0.102 Scheuer 3-4<br><0.102 Scheuer 0-2 | PPV = 35<br>NPV = 92 |
| *Indirect surrogate markers* | | | | |
| Forns | Age, plt, γGT, cholesterol | 7.811 − 3.131 × ln(plt) + 0.781 × ln(γGT) + 3.467 × ln(age) − 0.014 (cholesterol) | >6.9 ≈ Scheuer 2-4<br><4.2 ≈ Scheuer 0-1 | PPV = 66<br>NPV = 96 |
| APRI | AST, plt | ([AST/ULN]/plt [×10$^9$/l]) × 100 | >1.5 ≈ Ishak 3-6<br>≤0.5 ≈ Ishak 0-2 | PPV = 91<br>NPV = 90 |
| Fibrotest Fibrosure | Haptoglobin, a2-MC, apo-A1, γGT, bilirubin, γ-globulin | Proprietary | 0.75-1.00 ≈ F4<br>0.73-0.74 ≈ F3-F4<br>0.59-0.72 ≈ F3<br>0.49-0.58 ≈ F2<br>0.32-0.48 ≈ F1-F2<br>0.28-0.31 ≈ F1<br>0.22-0.27 ≈ F0-F1<br>0.00-0.21 ≈ F0 | PPV = 78<br>PPV = 76<br>PPV = 76<br>PPV = 67<br>PPV/NPV = 61/85<br>NPV = 91<br>NPV = 92<br>NPV = 94 |
| Fibroindex | Plt, AST, γGT | 1.738 − 0.064 (plt [¥10$^4$/mm$^3$]) + 0.005 (AST [IU/L]) + 0.463 × (γGT(g/dl)) | ≤1.25 ≈ F0-F1<br>≥2.25 ≈ F2-F3 | NPV = 61.7<br>PPV = 90 |
| Testa | Plt, spleen diameter | Plt count/spleen diameter | >1750 ≈ Ishak ≤2<br>≤1750 ≈ Ishak >2 | NPV = 79<br>PPV = 78.9c |
| Fibrosis probability index | AST, cholesterol, past alcohol intake, HOMA, age | E*/1 + e*, where * = −10.929 + (1.827 × ln[AST]) + (0.081 × age) + (0.768 × [past alcohol use graded as 0-2)) + (0.385 × HOMA) | <0.2 ≈ F0-F1<br>≥0.8 ≈ F2-F4 | NPV = 77.4<br>PPV = 87 |
| FIB-4 | Plt, AST, ALT, age | (Age × AST)/(plt count × ALT1/2) | <1.45 ≈ Ishak <4-6<br>>3.25 ≈ Ishak ≥4-6 | NPV = 90<br>PPV = 65 |
| Bonancini | ALT, AST, INR, plt | Sum (range 0-11) of (plt score) + (ALT/AST score) + (INR score) plt (×10$^9$/l): >340 = 0; 280-339 = 1; 220-279 = 2; 160-219 = 3; 100-159 = 4; 40-99 = 5; <40 = 6 ALT/AST ratio: >1.7 = 0; 1.2-1.7 = 1; 0.6-1.19 = 2; <0.6 = 3 INR: \1.4 = 2 | >8 ≈ Knodell 3-4 | PPV = 92.9 |
| Pohl | AST, ALT, plt | Positive if: AST/ALT ≥1 and platelet count <150 × 10$^9$/l | Positive ≈ F3-F4 | PPV = 93 |
| Shet | AST, ALT | AST/ALT | ≥1 ≈ Scheuer 4 | PPV = 100 |
| Park | AST, ALT | AST/ALT | ≥ Scheuer 4 | PPV = 73.7 |
| Age-Platelet | Plt, age | Age score + plt score (0-10 possible score) age: <30 = 0; 30-39 = 1; 40-49 = 2; 50-69 = 3; 60-69 = 4; ≥70 = 5, Plt (×10$^9$/l): ≥225 = 0; 200-224 = 1; 175-199 = 2; 150-174 = 3; 125-149 = 4; <125 = 5 | ≥6 ≈ F2-F4 | PPV = 96 |
| *Combined direct and indirect surrogate markers* | | | | |
| SHASTA | HA, AST, albumin | −3.84 + 1.70 (1 if HA 41-85 ng/ml, 0 otherwise) + 3.28 (1 if HA >85 ng/ml, 0 otherwise) + 1.58 (1 if albumin <3.5 g/dl, 0 otherwise) + 1.78 (1 if AST >60 IU/l, 0 otherwise) | >0.8 ≈ Ishak ≥3<br><0.3 ≈ Ishak ≤2 | PPV = 100<br>NPV = 94 |
| FM | plt, PI, AST, HA, α2-MC, gender, age | −0.007 plt (G/L) − 0.049 PI (%) + 0.012 AST (IU/l) + 0.005 α2-MC (mg/dl) + 0.021 HA (g/l) − 0.270 urea (mmol/l) + 0.027 age (years) + 3.718 | ≥F2 | PPV = 86.3/96.6 |
| Hepascore | HA, α2-MC, γGT, age, gender | y/1 + y, where y = exp [−4.185818 − (0.0249 × age) + 0.7464 × sex) + (1.0039 × α2-MC) + (0.0302 × HA) + (0.0691 × bilirubin) − (0.0012 × γGT)] | ≥0.5 ≈ F2-F4<br><0.5 ≈ F0-F1 | PPV = 88<br>NPV = 98 |
| FSII | HA, α2-MC, TIMP-1 | Proprietary | ≥42 ≈ F2-F4<br><40 ≈ F0-F1 | PPV = 77.4<br>NPV = 78 |

SEQUENCE LISTING (2860 sequences)

SEQ ID NO: 1 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (3)..(3): 2'-O-Methyl nucleotide
  modified_base (5)..(5): 2'-O-Methyl nucleotide
  modified_base (7)..(9): 2'-O-Methyl nucleotide
  modified_base (14)..(16): 2'-O-Methyl nucleotide
  modified_base (20)..(21): 2'-deoxythymidine
  misc_feature (20)..(21): Phosphorothioate linkage
uacaugucuagggucuagatt

SEQ ID NO: 2 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (10)..(10): 2'-O-Methyl nucleotide
  modified_base (14)..(14): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
ucuagacccuagacauguatt

SEQ ID NO: 3 - DNA, 21 bp, Artificial Sequence
  Description of Artificial Sequence: Synthetic oligonucleotide
  Description of Combined DNA/RNA Molecule: Synthetic oligonucleotide
  modified_base (2)..(4): 2'-O-Methyl nucleotide
  modified_base (6)..(6): 2'-O-Methyl nucleotide
  modified_base (8)..(8): 2'-O-Methyl nucleotide
  modified_base (10)..(12): 2'-O-Methyl nucleotide
  modified_base (17)..(19): 2'-O-Methyl nucleotide
  modified_base (20)..(21): 2'-deoxythymidine
  misc_feature (20)..(21): Phosphorothioate linkage
gucuacaugucuagggucutt

SEQ ID NO: 4 - DNA, 21 bp, Artificial Sequence
  Description of Artificial Sequence: Synthetic oligonucleotide
  Description of Combined DNA/RNA Molecule: Synthetic oligonucleotide
  modified_base (7)..(7): 2'-O-Methyl nucleotide
  modified_base (11)..(11): 2'-O-Methyl nucleotide
  modified_base (15)..(15): 2'-O-Methyl nucleotide
  modified_base (20)..(21): 2'-deoxythymidine
  misc_feature (20)..(21): Phosphorothioate linkage
agacccuagacauguagactt

SEQ ID NO: 5 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (4)..(4): 2'-O-Methyl nucleotide
  modified_base (6)..(6): 2'-O-Methyl nucleotide
  modified_base (8)..(10): 2'-O-Methyl nucleotide
  modified_base (15)..(17): 2'-O-Methyl nucleotide
  modified_base (20)..(21): 2'-deoxythymidine
  misc_feature (20)..(21): Phosphorothioate linkage
cuacaugucuagggucuagtt

SEQ ID NO: 6 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (9)..(9): 2'-O-Methyl nucleotide
  modified_base (13)..(13): 2'-O-Methyl nucleotide
  modified_base (17)..(17): 2'-O-Methyl nucleotide
  modified_base (20)..(21): 2'-deoxythymidine
  misc_feature (20)..(21): Phosphorothioate linkage
cuagacccuagacauguagtt

SEQ ID NO: 7 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (3)..(5): 2'-O-Methyl nucleotide
  modified_base (10)..(12): 2'-O-Methyl nucleotide
  modified_base (16)..(16): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
ugucuagggucuagacaugtt

SEQ ID NO: 8 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (7)..(7): 2'-O-Methyl nucleotide
  modified_base (14)..(14): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
caugucuagacccuagacatt

SEQ ID NO: 9 - DNA, 21 bp, Artificial Sequence
  Description of Artificial Sequence: Synthetic oligonucleotide
  Description of Combined DNA/RNA Molecule: Synthetic oligonucleotide
  modified_base (2)..(4): 2'-O-Methyl nucleotide
  modified_base (9)..(11): 2'-O-Methyl nucleotide
  modified_base (15)..(15): 2'-O-Methyl nucleotide
  modified_base (17)..(17): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
gucuagggucuagacaugutt

SEQ ID NO: 10 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (8)..(8): 2'-O-Methyl nucleotide
  modified_base (15)..(15): 2'-O-Methyl nucleotide
  modified_base (20)..(21): 2'-deoxythymidine
  misc_feature (20)..(21): Phosphorothioate linkage
acaugucuagacccuagactt

SEQ ID NO: 11 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (4)..(4): 2'-O-Methyl nucleotide
  modified_base (6)..(8): 2'-O-Methyl nucleotide
  modified_base (13)..(15): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
acaugucuagggucuagactt

SEQ ID NO: 12 - DNA, 21 bp, Artificial Sequence
  Description of Artificial Sequence: Synthetic oligonucleotide
  Description of Combined DNA/RNA Molecule: Synthetic oligonucleotide
  modified_base (4)..(4): 2'-O-Methyl nucleotide
  modified_base (11)..(11): 2'-O-Methyl nucleotide
  modified_base (15)..(15): 2'-O-Methyl nucleotide
  modified_base (20)..(21): 2'-deoxythymidine
  misc_feature (20)..(21): Phosphorothioate linkage
gucuagacccuagacaugutt

SEQ ID NO: 13 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (3)..(5): 2'-O-Methyl nucleotide
  modified_base (7)..(9): 2'-O-Methyl nucleotide
  modified_base (11)..(12): 2'-O-Methyl nucleotide
  modified_base (14)..(15): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
cgccugcccaucaucgaugtt

SEQ ID NO: 14 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (14)..(14): 2'-O-Methyl nucleotide
  modified_base (20)..(21): 2'-deoxythymidine
  misc_feature (20)..(21): Phosphorothioate linkage
caucgaugaugggcaggcgtt

SEQ ID NO: 15 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (12)..(13): 2'-O-Methyl nucleotide
  modified_base (15)..(18): 2'-O-Methyl nucleotide
  modified_base (20)..(21): 2'-deoxythymidine
  misc_feature (20)..(21): Phosphorothioate linkage
ggugagagaggucgcccugtt

SEQ ID NO: 16 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (16)..(16): 2'-O-Methyl nucleotide
  modified_base (20)..(21): 2'-deoxythymidine
  misc_feature (20)..(21): Phosphorothioate linkage
cagggcgaccucucucacctt

SEQ ID NO: 17 - DNA, 21 bp, Artificial Sequence
  Description of Artificial Sequence: Synthetic oligonucleotide
  Description of Combined DNA/RNA Molecule: Synthetic oligonucleotide
  modified_base (1)..(3): 2'-O-Methyl nucleotide
  modified_base (8)..(8): 2'-O-Methyl nucleotide
  modified_base (10)..(10): 2'-O-Methyl nucleotide
  modified_base (12)..(13): 2'-O-Methyl nucleotide
  modified_base (15)..(18): 2'-O-Methyl nucleotide
  modified_base (20)..(21): 2'-deoxythymidine
  misc_feature (20)..(21): Phosphorothioate linkage
cucaagaugugccacucugtt

SEQ ID NO: 18 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (9)..(9): 2'-O-Methyl nucleotide
  modified_base (11)..(11): 2'-O-Methyl nucleotide
  modified_base (20)..(21): 2'-deoxythymidine
  misc_feature (20)..(21): Phosphorothioate linkage
cagaguggcacaucuugagtt

SEQ ID NO: 19 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (3)..(3): 2'-O-Methyl nucleotide
  modified_base (5)..(7): 2'-O-Methyl nucleotide
  modified_base (10)..(13): 2'-O-Methyl nucleotide
  modified_base (15)..(16): 2'-O-Methyl nucleotide
  modified_base (20)..(21): 2'-deoxythymidine
  misc_feature (20)..(21): Phosphorothioate linkage
ugcauucaaccuuaccaaatt

SEQ ID NO: 20 - DNA, 21 bp, Artificial Sequence
  Description of Artificial Sequence: Synthetic oligonucleotide
  Description of Combined DNA/RNA Molecule: Synthetic oligonucleotide
  modified_base (6)..(6): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
uuugguaagguugaaugcatt

SEQ ID NO: 21 - DNA, 21 bp, Artificial Sequence
  Description of Artificial Sequence: Synthetic oligonucleotide
  Description of Combined DNA/RNA Molecule: Synthetic oligonucleotide
  modified_base (1)..(3): 2'-O-Methyl nucleotide
  modified_base (5)..(5): 2'-O-Methyl nucleotide
  modified_base (7)..(7): 2'-O-Methyl nucleotide
  modified_base (9)..(11): 2'-O-Methyl nucleotide
  modified_base (16)..(18): 2'-O-Methyl nucleotide
  modified_base (20)..(21): 2'-deoxythymidine
  misc_feature (20)..(21): Phosphorothioate linkage
ucuacaugucuagggucuatt

SEQ ID NO: 22 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (8)..(8): 2'-O-Methyl nucleotide
  modified_base (12)..(12): 2'-O-Methyl nucleotide
  modified_base (16)..(16): 2'-O-Methyl nucleotide
  modified_base (20)..(21): 2'-deoxythymidine
  misc_feature (20)..(21): Phosphorothioate linkage
uagacccuagacauguagatt

SEQ ID NO: 23 - DNA, 21 bp, Artificial Sequence
  Description of Artificial Sequence: Synthetic oligonucleotide
  Description of Combined DNA/RNA Molecule: Synthetic oligonucleotide
  modified_base (3)..(5): 2'-O-Methyl nucleotide
  modified_base (7)..(7): 2'-O-Methyl nucleotide
  modified_base (9)..(9): 2'-O-Methyl nucleotide
  modified_base (11)..(13): 2'-O-Methyl nucleotide
  modified_base (18)..(19): 2'-O-Methyl nucleotide
  modified_base (20)..(21): 2'-deoxythymidine
  misc_feature (20)..(21): Phosphorothioate linkage
agucuacaugucuaggguctt

SEQ ID NO: 24 - DNA, 21 bp, Artificial Sequence
  Description of Artificial Sequence: Synthetic oligonucleotide
  Description of Combined DNA/RNA Molecule: Synthetic oligonucleotide
  modified_base (6)..(6): 2'-O-Methyl nucleotide
  modified_base (10)..(10): 2'-O-Methyl nucleotide
  modified_base (14)..(14): 2'-O-Methyl nucleotide
  modified_base (20)..(21): 2'-deoxythymidine
  misc_feature (20)..(21): Phosphorothioate linkage
gacccuagacauguagacutt

SEQ ID NO: 25 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (8)..(8): 2'-O-Methyl nucleotide
  modified_base (10)..(10): 2'-O-Methyl nucleotide
  modified_base (17)..(18): 2'-O-Methyl nucleotide
  modified_base (20)..(21): 2'-deoxythymidine
  misc_feature (20)..(21): Phosphorothioate linkage
acagaggcauaaagggucatt

SEQ ID NO: 26 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): 2'-O-Methyl nucleotide
  modified_base (20)..(21): 2'-deoxythymidine
  misc_feature (20)..(21): Phosphorothioate linkage
ugacccuuuaugccucugutt

SEQ ID NO: 27 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (9)..(13): 2'-O-Methyl nucleotide
  modified_base (15)..(15): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
ggcaaagguccccguggugtt

SEQ ID NO: 28 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (4)..(4): 2'-O-Methyl nucleotide
  modified_base (20)..(21): 2'-deoxythymidine
  misc_feature (20)..(21): Phosphorothioate linkage
caccacggggaccuuugcctt

SEQ ID NO: 29 - DNA, 21 bp, Artificial Sequence
  Description of Artificial Sequence: Synthetic oligonucleotide
  Description of Combined DNA/RNA Molecule: Synthetic oligonucleotide
  modified_base (1)..(3): 2'-O-Methyl nucleotide
  modified_base (8)..(10): 2'-O-Methyl nucleotide
  modified_base (14)..(14): 2'-O-Methyl nucleotide
  modified_base (16)..(16): 2'-O-Methyl nucleotide
  modified_base (18)..(19): 2'-O-Methyl nucleotide
  modified_base (20)..(21): 2'-deoxythymidine
  misc_feature (20)..(21): Phosphorothioate linkage
ucuagggucuagacauguutt

SEQ ID NO: 30 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (9)..(9): 2'-O-Methyl nucleotide
  modified_base (16)..(16): 2'-O-Methyl nucleotide
  modified_base (20)..(21): 2'-deoxythymidine
  misc_feature (20)..(21): Phosphorothioate linkage
aacaugucuagacccuagatt

SEQ ID NO: 31 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (3)..(6): 2'-O-Methyl nucleotide
  modified_base (10)..(11): 2'-O-Methyl nucleotide
  modified_base (17)..(19): 2'-O-Methyl nucleotide
  modified_base (20)..(21): 2'-deoxythymidine
  misc_feature (20)..(21): Phosphorothioate linkage
ugccccagaccaggaauuctt

SEQ ID NO: 32 - DNA, 21 bp, Artificial Sequence
  Description of Artificial Sequence: Synthetic oligonucleotide
  Description of Combined DNA/RNA Molecule: Synthetic oligonucleotide
  modified_base (18)..(18): 2'-O-Methyl nucleotide
  modified_base (20)..(21): 2'-deoxythymidine
  misc_feature (20)..(21): Phosphorothioate linkage
gaauuccuggucuggggcatt

SEQ ID NO: 33 - DNA, 21 bp, Artificial Sequence
  Description of Artificial Sequence: Synthetic oligonucleotide
  Description of Combined DNA/RNA Molecule: Synthetic oligonucleotide
  modified_base (2)..(5): 2'-O-Methyl nucleotide
  modified_base (10)..(10): 2'-O-Methyl nucleotide
  modified_base (12)..(12): 2'-O-Methyl nucleotide
  modified_base (14)..(15): 2'-O-Methyl nucleotide
  modified_base (17)..(19): 2'-O-Methyl nucleotide
  modified_base (20)..(21): 2'-deoxythymidine
  misc_feature (20)..(21): Phosphorothioate linkage
accucaagaugugccacuctt

SEQ ID NO: 34 - DNA, 21 bp, Artificial Sequence
  Description of Artificial Sequence: Synthetic oligonucleotide
  Description of Combined DNA/RNA Molecule: Synthetic oligonucleotide
  modified_base (7)..(7): 2'-O-Methyl nucleotide
  modified_base (9)..(9): 2'-O-Methyl nucleotide
  modified_base (20)..(21): 2'-deoxythymidine
  misc_feature (20)..(21): Phosphorothioate linkage
gaguggcacaucuugaggutt

SEQ ID NO: 35 - DNA, 21 bp, Artificial Sequence
  Description of Artificial Sequence: Synthetic oligonucleotide
  Description of Combined DNA/RNA Molecule: Synthetic oligonucleotide
  modified_base (2)..(3): 2'-O-Methyl nucleotide
  modified_base (8)..(9): 2'-O-Methyl nucleotide
  modified_base (11)..(11): 2'-O-Methyl nucleotide
  modified_base (14)..(16): 2'-O-Methyl nucleotide
  modified_base (20)..(21): 2'-deoxythymidine
  misc_feature (20)..(21): Phosphorothioate linkage
accaaggcugcaaccuggatt

SEQ ID NO: 36 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (10)..(10): 2'-O-Methyl nucleotide
  modified_base (20)..(21): 2'-deoxythymidine
  misc_feature (20)..(21): Phosphorothioate linkage
uccagguugcagccuuggutt

SEQ ID NO: 37 - DNA, 21 bp, Artificial Sequence
  Description of Artificial Sequence: Synthetic oligonucleotide
  Description of Combined DNA/RNA Molecule: Synthetic oligonucleotide
  modified_base (1)..(3): 2'-O-Methyl nucleotide
  modified_base (7)..(7): 2'-O-Methyl nucleotide
  modified_base (9)..(9): 2'-O-Methyl nucleotide
  modified_base (11)..(13): 2'-O-Methyl nucleotide
  modified_base (16)..(19): 2'-O-Methyl nucleotide
  modified_base (20)..(21): 2'-deoxythymidine
  misc_feature (20)..(21): Phosphorothioate linkage
ucuagacauguucagcuuutt

SEQ ID NO: 38 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): 2'-O-Methyl nucleotide
  modified_base (16)..(16): 2'-O-Methyl nucleotide
  modified_base (20)..(21): 2'-deoxythymidine
  misc_feature (20)..(21): Phosphorothioate linkage
aaagcugaacaugucuagatt

SEQ ID NO: 39 - DNA, 21 bp, Artificial Sequence
  Description of Artificial Sequence: Synthetic oligonucleotide
  Description of Combined DNA/RNA Molecule: Synthetic oligonucleotide
  modified_base (1)..(3): 2'-O-Methyl nucleotide
  modified_base (6)..(6): 2'-O-Methyl nucleotide
  modified_base (9)..(10): 2'-O-Methyl nucleotide
  modified_base (12)..(12): 2'-O-Methyl nucleotide
  modified_base (15)..(19): 2'-O-Methyl nucleotide
  modified_base (20)..(21): 2'-deoxythymidine
  misc_feature (20)..(21): Phosphorothioate linkage
ccugguagccgugguuucctt

SEQ ID NO: 40 - DNA, 21 bp, Artificial Sequence
  Description of Artificial Sequence: Synthetic oligonucleotide
  Description of Combined DNA/RNA Molecule: Synthetic oligonucleotide
  modified_base (7)..(7): 2'-O-Methyl nucleotide
  modified_base (13)..(13): 2'-O-Methyl nucleotide
  modified_base (16)..(16): 2'-O-Methyl nucleotide
  modified_base (20)..(21): 2'-deoxythymidine
  misc_feature (20)..(21): Phosphorothioate linkage
ggaaaccacggcuaccaggtt

SEQ ID NO: 41 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (5)..(5): 2'-O-Methyl nucleotide
  modified_base (7)..(9): 2'-O-Methyl nucleotide
  modified_base (12)..(15): 2'-O-Methyl nucleotide
  modified_base (17)..(18): 2'-O-Methyl nucleotide
  modified_base (20)..(21): 2'-deoxythymidine
  misc_feature (20)..(21): Phosphorothioate linkage
agugcauucaaccuuaccatt

SEQ ID NO: 42 - DNA, 21 bp, Artificial Sequence
  Description of Artificial Sequence: Synthetic oligonucleotide
  Description of Combined DNA/RNA Molecule: Synthetic oligonucleotide
  modified_base (4)..(4): 2'-O-Methyl nucleotide
  modified_base (16)..(16): 2'-O-Methyl nucleotide
  modified_base (20)..(21): 2'-deoxythymidine
  misc_feature (20)..(21): Phosphorothioate linkage
ugguaagguugaaugcacutt

SEQ ID NO: 43 - DNA, 21 bp, Artificial Sequence
  Description of Artificial Sequence: Synthetic oligonucleotide
  Description of Combined DNA/RNA Molecule: Synthetic oligonucleotide
  modified_base (5)..(5): 2'-O-Methyl nucleotide
  modified_base (7)..(7): 2'-O-Methyl nucleotide
  modified_base (10)..(11): 2'-O-Methyl nucleotide
  modified_base (14)..(14): 2'-O-Methyl nucleotide
  modified_base (18)..(19): 2'-O-Methyl nucleotide
  modified_base (20)..(21): 2'-deoxythymidine
  misc_feature (20)..(21): Phosphorothioate linkage
agagcaugaccgauggauutt

SEQ ID NO: 44 - DNA, 21 bp, Artificial Sequence
  Description of Artificial Sequence: Synthetic oligonucleotide
  Description of Combined DNA/RNA Molecule: Synthetic oligonucleotide
  modified_base (5)..(5): 2'-O-Methyl nucleotide
  modified_base (12)..(12): 2'-O-Methyl nucleotide
  modified_base (20)..(21): 2'-deoxythymidine
  misc_feature (20)..(21): Phosphorothioate linkage
aauccaucggucaugcucutt

SEQ ID NO: 45 - DNA, 21 bp, Artificial Sequence
  Description of Artificial Sequence: Synthetic oligonucleotide
  Description of Combined DNA/RNA Molecule: Synthetic oligonucleotide
  modified_base (4)..(6): 2'-O-Methyl nucleotide
  modified_base (8)..(8): 2'-O-Methyl nucleotide
  modified_base (10)..(10): 2'-O-Methyl nucleotide
  modified_base (12)..(14): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
gagucuacaugucuagggutt

SEQ ID NO: 46 - DNA, 21 bp, Artificial Sequence
  Description of Artificial Sequence: Synthetic oligonucleotide
  Description of Combined DNA/RNA Molecule: Synthetic oligonucleotide
  modified_base (5)..(5): 2'-O-Methyl nucleotide
  modified_base (9)..(9): 2'-O-Methyl nucleotide
  modified_base (13)..(13): 2'-O-Methyl nucleotide
  modified_base (20)..(21): 2'-deoxythymidine
  misc_feature (20)..(21): Phosphorothioate linkage
acccuagacauguagacuctt

SEQ ID NO: 47 - DNA, 21 bp, Artificial Sequence
  Description of Artificial Sequence: Synthetic oligonucleotide
  Description of Combined DNA/RNA Molecule: Synthetic oligonucleotide
  modified_base (1)..(4): 2'-O-Methyl nucleotide
  modified_base (6)..(6): 2'-O-Methyl nucleotide
  modified_base (10)..(14): 2'-O-Methyl nucleotide
  modified_base (17)..(19): 2'-O-Methyl nucleotide
  modified_base (20)..(21): 2'-deoxythymidine
  misc_feature (20)..(21): Phosphorothioate linkage
cuuuguggaccuccggcuctt

SEQ ID NO: 48 - DNA, 21 bp, Artificial Sequence
  Description of Artificial Sequence: Synthetic oligonucleotide
  Description of Combined DNA/RNA Molecule: Synthetic oligonucleotide
  modified_base (13)..(13): 2'-O-Methyl nucleotide
  modified_base (15)..(15): 2'-O-Methyl nucleotide
  modified_base (20)..(21): 2'-deoxythymidine
  misc_feature (20)..(21): Phosphorothioate linkage
gagccggagguccacaaagtt

SEQ ID NO: 49 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (4)..(6): 2'-O-Methyl nucleotide
  modified_base (8)..(9): 2'-O-Methyl nucleotide
  modified_base (11)..(12): 2'-O-Methyl nucleotide
  modified_base (15)..(15): 2'-O-Methyl nucleotide
  modified_base (17)..(17): 2'-O-Methyl nucleotide
  modified_base (20)..(21): 2'-deoxythymidine
  misc_feature (20)..(21): Phosphorothioate linkage
cugcccaucaucgauguggtt

SEQ ID NO: 50 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (4)..(4): 2'-O-Methyl nucleotide
  modified_base (17)..(17): 2'-O-Methyl nucleotide
  modified_base (20)..(21): 2'-deoxythymidine
  misc_feature (20)..(21): Phosphorothioate linkage
ccacaucgaugaugggcagtt

SEQ ID NO: 51 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (5)..(5): 2'-O-Methyl nucleotide
  modified_base (8)..(8): 2'-O-Methyl nucleotide
  modified_base (10)..(14): 2'-O-Methyl nucleotide
  modified_base (17)..(17): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
ccaauggugcuccugguautt

SEQ ID NO: 52 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (5)..(5): 2'-O-Methyl nucleotide
  modified_base (11)..(11): 2'-O-Methyl nucleotide
  modified_base (14)..(14): 2'-O-Methyl nucleotide
  modified_base (20)..(21): 2'-deoxythymidine
  misc_feature (20)..(21): Phosphorothioate linkage
auaccaggagcaccauuggtt

SEQ ID NO: 53 - DNA, 21 bp, Artificial Sequence
  Description of Artificial Sequence: Synthetic oligonucleotide
  Description of Combined DNA/RNA Molecule: Synthetic oligonucleotide
  modified_base (2)..(4): 2'-O-Methyl nucleotide
  modified_base (8)..(8): 2'-O-Methyl nucleotide
  modified_base (10)..(10): 2'-O-Methyl nucleotide
  modified_base (12)..(14): 2'-O-Methyl nucleotide
  modified_base (17)..(19): 2'-O-Methyl nucleotide
  modified_base (20)..(21): 2'-deoxythymidine
  misc_feature (20)..(21): Phosphorothioate linkage
gucuagacauguucagcuutt

SEQ ID NO: 54 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): 2'-O-Methyl nucleotide
  modified_base (15)..(15): 2'-O-Methyl nucleotide
  modified_base (20)..(21): 2'-deoxythymidine
  misc_feature (20)..(21): Phosphorothioate linkage
aagcugaacaugucuagactt

SEQ ID NO: 55 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (4)..(6): 2'-O-Methyl nucleotide
  modified_base (9)..(12): 2'-O-Methyl nucleotide
  modified_base (14)..(15): 2'-O-Methyl nucleotide
  modified_base (20)..(21): 2'-deoxythymidine
  misc_feature (20)..(21): Phosphorothioate linkage
gcauucaaccuuaccaaaatt

SEQ ID NO: 56 - DNA, 21 bp, Artificial Sequence
  Description of Artificial Sequence: Synthetic oligonucleotide
  Description of Combined DNA/RNA Molecule: Synthetic oligonucleotide
  modified_base (7)..(7): 2'-O-Methyl nucleotide
  modified_base (20)..(21): 2'-deoxythymidine
  misc_feature (20)..(21): Phosphorothioate linkage
uuuugguaagguugaaugctt

SEQ ID NO: 57 - DNA, 21 bp, Artificial Sequence
  Description of Artificial Sequence: Synthetic oligonucleotide
  Description of Combined DNA/RNA Molecule: Synthetic oligonucleotide
  modified_base (1)..(3): 2'-O-Methyl nucleotide
  modified_base (5)..(7): 2'-O-Methyl nucleotide
  modified_base (9)..(10): 2'-O-Methyl nucleotide
  modified_base (12)..(13): 2'-O-Methyl nucleotide
  modified_base (16)..(16): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
ccugcccaucaucgaugugtt

SEQ ID NO: 58 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (3)..(3): 2'-O-Methyl nucleotide
  modified_base (16)..(16): 2'-O-Methyl nucleotide
  modified_base (20)..(21): 2'-deoxythymidine
  misc_feature (20)..(21): Phosphorothioate linkage
cacaucgaugaugggcaggtt

SEQ ID NO: 59 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (4)..(6): 2'-O-Methyl nucleotide
  modified_base (8)..(10): 2'-O-Methyl nucleotide
  modified_base (12)..(13): 2'-O-Methyl nucleotide
  modified_base (15)..(16): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
ccgccugcccaucaucgautt

SEQ ID NO: 60 - DNA, 21 bp, Artificial Sequence
  Description of Artificial Sequence: Synthetic oligonucleotide
  Description of Combined DNA/RNA Molecule: Synthetic oligonucleotide
  modified_base (13)..(13): 2'-O-Methyl nucleotide
  modified_base (20)..(21): 2'-deoxythymidine
  misc_feature (20)..(21): Phosphorothioate linkage
aucgaugaugggcaggcggtt

SEQ ID NO: 61 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (9)..(9): 2'-O-Methyl nucleotide
  modified_base (11)..(11): 2'-O-Methyl nucleotide
  modified_base (18)..(19): 2'-O-Methyl nucleotide
  modified_base (20)..(21): 2'-deoxythymidine
  misc_feature (20)..(21): Phosphorothioate linkage
gacagaggcauaaaggguctt

SEQ ID NO: 62 - DNA, 21 bp, Artificial Sequence
  Description of Artificial Sequence: Synthetic oligonucleotide
  Description of Combined DNA/RNA Molecule: Synthetic oligonucleotide
  modified_base (8)..(8): 2'-O-Methyl nucleotide
  modified_base (20)..(21): 2'-deoxythymidine
  misc_feature (20)..(21): Phosphorothioate linkage
gacccuuuaugccucuguctt

SEQ ID NO: 63 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (4)..(4): 2'-O-Methyl nucleotide
  modified_base (6)..(11): 2'-O-Methyl nucleotide
  modified_base (14)..(14): 2'-O-Methyl nucleotide
  modified_base (16)..(16): 2'-O-Methyl nucleotide
  modified_base (18)..(19): 2'-O-Methyl nucleotide
  modified_base (20)..(21): 2'-deoxythymidine
  misc_feature (20)..(21): Phosphorothioate linkage
auauguucuucaauacguctt

SEQ ID NO: 64 - DNA, 21 bp, Artificial Sequence
  Description of Artificial Sequence: Synthetic oligonucleotide
  Description of Combined DNA/RNA Molecule: Synthetic oligonucleotide
  modified_base (5)..(5): 2'-O-Methyl nucleotide
  modified_base (15)..(15): 2'-O-Methyl nucleotide
  modified_base (17)..(17): 2'-O-Methyl nucleotide
  modified_base (20)..(21): 2'-deoxythymidine
  misc_feature (20)..(21): Phosphorothioate linkage
gacguauugaagaacauautt

SEQ ID NO: 65 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (3)..(3): 2'-O-Methyl nucleotide
  modified_base (5)..(5): 2'-O-Methyl nucleotide
  modified_base (7)..(12): 2'-O-Methyl nucleotide
  modified_base (15)..(15): 2'-O-Methyl nucleotide
  modified_base (17)..(17): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
uauauguucuucaauacgutt

SEQ ID NO: 66 - DNA, 21 bp, Artificial Sequence
  Description of Artificial Sequence: Synthetic oligonucleotide
  Description of Combined DNA/RNA Molecule: Synthetic oligonucleotide
  modified_base (4)..(4): 2'-O-Methyl nucleotide
  modified_base (14)..(14): 2'-O-Methyl nucleotide
  modified_base (16)..(16): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
acguauugaagaacauauatt

SEQ ID NO: 67 - DNA, 21 bp, Artificial Sequence
  Description of Artificial Sequence: Synthetic oligonucleotide
  Description of Combined DNA/RNA Molecule: Synthetic oligonucleotide
  modified_base (1)..(4): 2'-O-Methyl nucleotide
  modified_base (7)..(7): 2'-O-Methyl nucleotide
  modified_base (9)..(10): 2'-O-Methyl nucleotide
  modified_base (13)..(13): 2'-O-Methyl nucleotide
  modified_base (15)..(17): 2'-O-Methyl nucleotide
  modified_base (20)..(21): 2'-deoxythymidine
  misc_feature (20)..(21): Phosphorothioate linkage
uucuagugcugacgcccggtt

SEQ ID NO: 68 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): 2'-O-Methyl nucleotide
  modified_base (12)..(12): 2'-O-Methyl nucleotide
  modified_base (15)..(15): 2'-O-Methyl nucleotide
  modified_base (20)..(21): 2'-deoxythymidine
  misc_feature (20)..(21): Phosphorothioate linkage
ccgggcgucagcacuagaatt

SEQ ID NO: 69 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (3)..(5): 2'-O-Methyl nucleotide
  modified_base (9)..(10): 2'-O-Methyl nucleotide
  modified_base (15)..(17): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
uguccaaacuaaggcucgctt

SEQ ID NO: 70 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
gcgagccuuaguuuggacatt

SEQ ID NO: 71 - DNA, 21 bp, Artificial Sequence
  Description of Artificial Sequence: Synthetic oligonucleotide
  Description of Combined DNA/RNA Molecule: Synthetic oligonucleotide
  modified_base (2)..(4): 2'-O-Methyl nucleotide
  modified_base (8)..(9): 2'-O-Methyl nucleotide
  modified_base (14)..(16): 2'-O-Methyl nucleotide
  modified_base (18)..(19): 2'-O-Methyl nucleotide
  modified_base (20)..(21): 2'-deoxythymidine
  misc_feature (20)..(21): Phosphorothioate linkage
guccaaacuaaggcucgcctt

SEQ ID NO: 72 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): 2'-O-Methyl nucleotide
  modified_base (20)..(21): 2'-deoxythymidine
  misc_feature (20)..(21): Phosphorothioate linkage
ggcgagccuuaguuuggactt

SEQ ID NO: 73 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (6)..(6): 2'-O-Methyl nucleotide
  modified_base (8)..(10): 2'-O-Methyl nucleotide
  modified_base (12)..(12): 2'-O-Methyl nucleotide
  modified_base (15)..(16): 2'-O-Methyl nucleotide
  modified_base (20)..(21): 2'-deoxythymidine
  misc_feature (20)..(21): Phosphorothioate linkage
aacagcacccgcgaccgggtt

SEQ ID NO: 74 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): 2'-deoxythymidine
  misc_feature (20)..(21): Phosphorothioate linkage
cccggucgcgggugcuguutt

SEQ ID NO: 75 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (4)..(6): 2'-O-Methyl nucleotide
  modified_base (8)..(8): 2'-O-Methyl nucleotide
  modified_base (10)..(10): 2'-O-Methyl nucleotide
  modified_base (12)..(13): 2'-O-Methyl nucleotide
  modified_base (16)..(16): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
ucacccgcgugcuaauggutt

SEQ ID NO: 76 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (6)..(6): 2'-O-Methyl nucleotide
  modified_base (9)..(9): 2'-O-Methyl nucleotide
  modified_base (20)..(21): 2'-deoxythymidine
  misc_feature (20)..(21): Phosphorothioate linkage
accauuagcacgcgggugatt

SEQ ID NO: 77 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (5)..(5): 2'-O-Methyl nucleotide
  modified_base (8)..(12): 2'-O-Methyl nucleotide
  modified_base (15)..(15): 2'-O-Methyl nucleotide
  modified_base (17)..(18): 2'-O-Methyl nucleotide
  modified_base (20)..(21): 2'-deoxythymidine
  misc_feature (20)..(21): Phosphorothioate linkage
gcaacaauuccuggcguuatt

SEQ ID NO: 78 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (7)..(7): 2'-O-Methyl nucleotide
  modified_base (20)..(21): 2'-deoxythymidine
  misc_feature (20)..(21): Phosphorothioate linkage
uaacgccaggaauuguugctt

SEQ ID NO: 79 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (5)..(5): 2'-O-Methyl nucleotide
  modified_base (7)..(9): 2'-O-Methyl nucleotide
  modified_base (11)..(11): 2'-O-Methyl nucleotide
  modified_base (14)..(15): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
acagcacccgcgaccgggutt

SEQ ID NO: 80 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): 2'-deoxythymidine
  misc_feature (20)..(21): Phosphorothioate linkage
acccggucgcgggugcugutt

SEQ ID NO: 81 - DNA, 21 bp, Artificial Sequence
  Description of Artificial Sequence: Synthetic oligonucleotide
  Description of Combined DNA/RNA Molecule: Synthetic oligonucleotide
  modified_base (2)..(3): 2'-O-Methyl nucleotide
  modified_base (8)..(9): 2'-O-Methyl nucleotide
  modified_base (11)..(13): 2'-O-Methyl nucleotide
  modified_base (15)..(15): 2'-O-Methyl nucleotide
  modified_base (18)..(19): 2'-O-Methyl nucleotide
  modified_base (20)..(21): 2'-deoxythymidine
  misc_feature (20)..(21): Phosphorothioate linkage
aucgaagccauccguggcctt

SEQ ID NO: 82 - DNA, 21 bp, Artificial Sequence
  Description of Artificial Sequence: Synthetic oligonucleotide
  Description of Combined DNA/RNA Molecule: Synthetic oligonucleotide
  modified_base (4)..(4): 2'-O-Methyl nucleotide
  modified_base (20)..(21): 2'-deoxythymidine
  misc_feature (20)..(21): Phosphorothioate linkage
ggccacggauggcuucgautt

SEQ ID NO: 83 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (5)..(5): 2'-O-Methyl nucleotide
  modified_base (7)..(8): 2'-O-Methyl nucleotide
  modified_base (12)..(12): 2'-O-Methyl nucleotide
  modified_base (14)..(16): 2'-O-Methyl nucleotide
  modified_base (20)..(21): 2'-deoxythymidine
  misc_feature (20)..(21): Phosphorothioate linkage
aauacgucagacauucgggtt

SEQ ID NO: 84 - DNA, 21 bp, Artificial Sequence
  Description of Artificial Sequence: Synthetic oligonucleotide
  Description of Combined DNA/RNA Molecule: Synthetic oligonucleotide
  modified_base (16)..(16): 2'-O-Methyl nucleotide
  modified_base (20)..(21): 2'-deoxythymidine
  misc_feature (20)..(21): Phosphorothioate linkage
cccgaaugucugacguauutt

SEQ ID NO: 85 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (4)..(4): 2'-O-Methyl nucleotide
  modified_base (6)..(6): 2'-O-Methyl nucleotide
  modified_base (8)..(9): 2'-O-Methyl nucleotide
  modified_base (13)..(13): 2'-O-Methyl nucleotide
  modified_base (15)..(17): 2'-O-Methyl nucleotide
  modified_base (20)..(21): 2'-deoxythymidine
  misc_feature (20)..(21): Phosphorothioate linkage
caauacgucagacauucggtt

SEQ ID NO: 86 - DNA, 21 bp, Artificial Sequence
  Description of Artificial Sequence: Synthetic oligonucleotide
  Description of Combined DNA/RNA Molecule: Synthetic oligonucleotide
  modified_base (15)..(15): 2'-O-Methyl nucleotide
  modified_base (20)..(21): 2'-deoxythymidine
  misc_feature (20)..(21): Phosphorothioate linkage
ccgaaugucugacguauugtt

SEQ ID NO: 87 - DNA, 21 bp, Artificial Sequence
  Description of Artificial Sequence: Synthetic oligonucleotide
  Description of Combined DNA/RNA Molecule: Synthetic oligonucleotide
  modified_base (4)..(5): 2'-O-Methyl nucleotide
  modified_base (7)..(8): 2'-O-Methyl nucleotide
  modified_base (10)..(12): 2'-O-Methyl nucleotide
  modified_base (14)..(19): 2'-O-Methyl nucleotide
  modified_base (20)..(21): 2'-deoxythymidine
  misc_feature (20)..(21): Phosphorothioate linkage
ggacuaucaccuaccuuuctt

SEQ ID NO: 88 - DNA, 21 bp, Artificial Sequence
  Description of Artificial Sequence: Synthetic oligonucleotide
  Description of Combined DNA/RNA Molecule: Synthetic oligonucleotide
  modified_base (7)..(7): 2'-O-Methyl nucleotide
  modified_base (14)..(14): 2'-O-Methyl nucleotide
  modified_base (20)..(21): 2'-deoxythymidine
  misc_feature (20)..(21): Phosphorothioate linkage
gaaagguaggugauagucctt

SEQ ID NO: 89 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (3)..(3): 2'-O-Methyl nucleotide
  modified_base (5)..(6): 2'-O-Methyl nucleotide
  modified_base (11)..(12): 2'-O-Methyl nucleotide
  modified_base (14)..(16): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
cgcaucgaagccauccgugtt

SEQ ID NO: 90 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (20)..(21): 2'-deoxythymidine
  misc_feature (20)..(21): Phosphorothioate linkage
cacggauggcuucgaugcgtt

SEQ ID NO: 91 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (4)..(6): 2'-O-Methyl nucleotide
  modified_base (11)..(12): 2'-O-Methyl nucleotide
  modified_base (14)..(15): 2'-O-Methyl nucleotide
  modified_base (17)..(19): 2'-O-Methyl nucleotide
  modified_base (20)..(21): 2'-deoxythymidine
  misc_feature (20)..(21): Phosphorothioate linkage
uuauucaggacuaucaccutt

SEQ ID NO: 92 - DNA, 21 bp, Artificial Sequence
  Description of Artificial Sequence: Synthetic oligonucleotide
  Description of Combined DNA/RNA Molecule: Synthetic oligonucleotide
  modified_base (7)..(7): 2'-O-Methyl nucleotide
  modified_base (17)..(17): 2'-O-Methyl nucleotide
  modified_base (20)..(21): 2'-deoxythymidine
  misc_feature (20)..(21): Phosphorothioate linkage
aggugauaguccugaauaatt

SEQ ID NO: 93 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (6)..(6): 2'-O-Methyl nucleotide
  modified_base (10)..(11): 2'-O-Methyl nucleotide
  modified_base (13)..(13): 2'-O-Methyl nucleotide
  modified_base (16)..(16): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
aaugguggaccgcaacaactt

SEQ ID NO: 94 - DNA, 21 bp, Artificial Sequence
  Description of Artificial Sequence: Synthetic oligonucleotide
  Description of Combined DNA/RNA Molecule: Synthetic oligonucleotide
  modified_base (13)..(13): 2'-O-Methyl nucleotide
  modified_base (16)..(16): 2'-O-Methyl nucleotide
  modified_base (20)..(21): 2'-deoxythymidine
  misc_feature (20)..(21): Phosphorothioate linkage
guuguugcgguccaccauutt

SEQ ID NO: 95 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (4)..(5): 2'-O-Methyl nucleotide
  modified_base (7)..(7): 2'-O-Methyl nucleotide
  modified_base (9)..(9): 2'-O-Methyl nucleotide
  modified_base (13)..(14): 2'-O-Methyl nucleotide
  modified_base (16)..(16): 2'-O-Methyl nucleotide
  modified_base (20)..(21): 2'-deoxythymidine
  misc_feature (20)..(21): Phosphorothioate linkage
cuacuacgugggucgcaagtt

SEQ ID NO: 96 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): 2'-O-Methyl nucleotide
  modified_base (14)..(14): 2'-O-Methyl nucleotide
  modified_base (17)..(17): 2'-O-Methyl nucleotide
  modified_base (20)..(21): 2'-deoxythymidine
  misc_feature (20)..(21): Phosphorothioate linkage
cuugcgacccacguaguagtt

SEQ ID NO: 97 - DNA, 21 bp, Artificial Sequence
  Description of Artificial Sequence: Synthetic oligonucleotide
  Description of Combined DNA/RNA Molecule: Synthetic oligonucleotide
  modified_base (1)..(5): 2'-O-Methyl nucleotide
  modified_base (8)..(8): 2'-O-Methyl nucleotide
  modified_base (10)..(11): 2'-O-Methyl nucleotide
  modified_base (14)..(14): 2'-O-Methyl nucleotide
  modified_base (16)..(18): 2'-O-Methyl nucleotide
  modified_base (20)..(21): 2'-deoxythymidine
  misc_feature (20)..(21): Phosphorothioate linkage
cuucuagugcugacgcccgtt

SEQ ID NO: 98 - DNA, 21 bp, Artificial Sequence
  Description of Artificial Sequence: Synthetic oligonucleotide
  Description of Combined DNA/RNA Molecule: Synthetic oligonucleotide
  modified_base (8)..(8): 2'-O-Methyl nucleotide
  modified_base (11)..(11): 2'-O-Methyl nucleotide
  modified_base (14)..(14): 2'-O-Methyl nucleotide
  modified_base (20)..(21): 2'-deoxythymidine
  misc_feature (20)..(21): Phosphorothioate linkage
cgggcgucagcacuagaagtt

SEQ ID NO: 99 - DNA, 21 bp, Artificial Sequence
  Description of Artificial Sequence: Synthetic oligonucleotide
  Description of Combined DNA/RNA Molecule: Synthetic oligonucleotide
  modified_base (2)..(7): 2'-O-Methyl nucleotide
  modified_base (10)..(10): 2'-O-Methyl nucleotide
  modified_base (12)..(12): 2'-O-Methyl nucleotide
  modified_base (14)..(15): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
guucuucaauacgucagactt

SEQ ID NO: 100 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): 2'-O-Methyl nucleotide
  modified_base (20)..(21): 2'-deoxythymidine
  misc_feature (20)..(21): Phosphorothioate linkage
gucugacguauugaagaactt

SEQ ID NO: 101 - DNA, 21 bp, Artificial Sequence
  Description of Artificial Sequence: Synthetic oligonucleotide
  Description of Combined DNA/RNA Molecule: Synthetic oligonucleotide
  modified_base (1)..(4): 2'-O-Methyl nucleotide
  modified_base (6)..(7): 2'-O-Methyl nucleotide
  modified_base (10)..(10): 2'-O-Methyl nucleotide
  modified_base (12)..(12): 2'-O-Methyl nucleotide
  modified_base (14)..(16): 2'-O-Methyl nucleotide
  modified_base (20)..(21): 2'-deoxythymidine
  misc_feature (20)..(21): Phosphorothioate linkage
ccccacugauacgccugagtt

SEQ ID NO: 102 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (9)..(9): 2'-O-Methyl nucleotide
  modified_base (12)..(12): 2'-O-Methyl nucleotide
  modified_base (20)..(21): 2'-deoxythymidine
  misc_feature (20)..(21): Phosphorothioate linkage
cucaggcguaucaguggggtt

SEQ ID NO: 103 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (6)..(7): 2'-O-Methyl nucleotide
  modified_base (12)..(14): 2'-O-Methyl nucleotide
  modified_base (16)..(17): 2'-O-Methyl nucleotide
  modified_base (20)..(21): 2'-deoxythymidine
  misc_feature (20)..(21): Phosphorothioate linkage
ccaaacuaaggcucgccagtt

SEQ ID NO: 104 - DNA, 21 bp, Artificial Sequence
  Description of Artificial Sequence: Synthetic oligonucleotide
  Description of Combined DNA/RNA Molecule: Synthetic oligonucleotide
  modified_base (12)..(12): 2'-O-Methyl nucleotide
  modified_base (20)..(21): 2'-deoxythymidine
  misc_feature (20)..(21): Phosphorothioate linkage
cuggcgagccuuaguuuggtt

SEQ ID NO: 105 - DNA, 21 bp, Artificial Sequence
  Description of Artificial Sequence: Synthetic oligonucleotide
  Description of Combined DNA/RNA Molecule: Synthetic oligonucleotide
  modified_base (1)..(4): 2'-O-Methyl nucleotide
  modified_base (6)..(7): 2'-O-Methyl nucleotide
  modified_base (13)..(13): 2'-O-Methyl nucleotide
  modified_base (15)..(15): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
cucuaccagaaauauagcatt

SEQ ID NO: 106 - DNA, 21 bp, Artificial Sequence
  Description of Artificial Sequence: Synthetic oligonucleotide
  Description of Combined DNA/RNA Molecule: Synthetic oligonucleotide
  modified_base (4)..(4): 2'-O-Methyl nucleotide
  modified_base (6)..(6): 2'-O-Methyl nucleotide
  modified_base (15)..(15): 2'-O-Methyl nucleotide
  modified_base (20)..(21): 2'-deoxythymidine
  misc_feature (20)..(21): Phosphorothioate linkage
ugcuauauuucugguagagtt

SEQ ID NO: 107 - DNA, 21 bp, Artificial Sequence
  Description of Artificial Sequence: Synthetic oligonucleotide
  Description of Combined DNA/RNA Molecule: Synthetic oligonucleotide
  modified_base (1)..(6): 2'-O-Methyl nucleotide
  modified_base (9)..(9): 2'-O-Methyl nucleotide
  modified_base (11)..(11): 2'-O-Methyl nucleotide
  modified_base (13)..(14): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
uucuucaauacgucagacatt

SEQ ID NO: 108 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): 2'-O-Methyl nucleotide
  modified_base (20)..(21): 2'-deoxythymidine
  misc_feature (20)..(21): Phosphorothioate linkage
ugucugacguauugaagaatt

SEQ ID NO: 109 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (4)..(4): 2'-O-Methyl nucleotide
  modified_base (8)..(9): 2'-O-Methyl nucleotide
  modified_base (11)..(11): 2'-O-Methyl nucleotide
  modified_base (14)..(14): 2'-O-Methyl nucleotide
  modified_base (17)..(17): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
ugguggaccgcaacaacgctt

SEQ ID NO: 110 - DNA, 21 bp, Artificial Sequence
  Description of Artificial Sequence: Synthetic oligonucleotide
  Description of Combined DNA/RNA Molecule: Synthetic oligonucleotide
  modified_base (15)..(15): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
gcguuguugcgguccaccatt

SEQ ID NO: 111 - DNA, 21 bp, Artificial Sequence
  Description of Artificial Sequence: Synthetic oligonucleotide
  Description of Combined DNA/RNA Molecule: Synthetic oligonucleotide
  modified_base (2)..(3): 2'-O-Methyl nucleotide
  modified_base (5)..(5): 2'-O-Methyl nucleotide
  modified_base (7)..(7): 2'-O-Methyl nucleotide
  modified_base (9)..(10): 2'-O-Methyl nucleotide
  modified_base (13)..(16): 2'-O-Methyl nucleotide
  modified_base (20)..(21): 2'-deoxythymidine
  misc_feature (20)..(21): Phosphorothioate linkage
gcuguacauugacuuuaggtt

SEQ ID NO: 112 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (9)..(9): 2'-O-Methyl nucleotide
  modified_base (14)..(14): 2'-O-Methyl nucleotide
  modified_base (16)..(16): 2'-O-Methyl nucleotide
  modified_base (20)..(21): 2'-deoxythymidine
  misc_feature (20)..(21): Phosphorothioate linkage
ccuaaagucaauguacagctt

SEQ ID NO: 113 - DNA, 21 bp, Artificial Sequence
  Description of Artificial Sequence: Synthetic oligonucleotide
  Description of Combined DNA/RNA Molecule: Synthetic oligonucleotide
  modified_base (1)..(5): 2'-O-Methyl nucleotide
  modified_base (8)..(8): 2'-O-Methyl nucleotide
  modified_base (10)..(11): 2'-O-Methyl nucleotide
  modified_base (13)..(16): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
uuccuggcguuaccuuggutt

SEQ ID NO: 114 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (8)..(8): 2'-O-Methyl nucleotide
  modified_base (14)..(14): 2'-O-Methyl nucleotide
  modified_base (20)..(21): 2'-deoxythymidine
  misc_feature (20)..(21): Phosphorothioate linkage
accaagguaacgccaggaatt

SEQ ID NO: 115 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (5)..(5): 2'-O-Methyl nucleotide
  modified_base (9)..(10): 2'-O-Methyl nucleotide
  modified_base (12)..(12): 2'-O-Methyl nucleotide
  modified_base (15)..(15): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
augguggaccgcaacaacgtt

SEQ ID NO: 116 - DNA, 21 bp, Artificial Sequence
  Description of Artificial Sequence: Synthetic oligonucleotide
  Description of Combined DNA/RNA Molecule: Synthetic oligonucleotide
  modified_base (14)..(14): 2'-O-Methyl nucleotide
  modified_base (17)..(17): 2'-O-Methyl nucleotide
  modified_base (20)..(21): 2'-deoxythymidine
  misc_feature (20)..(21): Phosphorothioate linkage
cguuguugcgguccaccautt

SEQ ID NO: 117 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (5)..(5): 2'-O-Methyl nucleotide
  modified_base (8)..(8): 2'-O-Methyl nucleotide
  modified_base (12)..(13): 2'-O-Methyl nucleotide
  modified_base (15)..(15): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
cuaaugguggaccgcaacatt

SEQ ID NO: 118 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): 2'-O-Methyl nucleotide
  modified_base (14)..(14): 2'-O-Methyl nucleotide
  modified_base (17)..(17): 2'-O-Methyl nucleotide
  modified_base (20)..(21): 2'-deoxythymidine
  misc_feature (20)..(21): Phosphorothioate linkage
uguugcgguccaccauuagtt

SEQ ID NO: 119 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (5)..(5): 2'-O-Methyl nucleotide
  modified_base (7)..(9): 2'-O-Methyl nucleotide
  modified_base (11)..(14): 2'-O-Methyl nucleotide
  modified_base (16)..(16): 2'-O-Methyl nucleotide
  modified_base (18)..(18): 2'-O-Methyl nucleotide
  modified_base (20)..(21): 2'-deoxythymidine
  misc_feature (20)..(21): Phosphorothioate linkage
gcggugcucgcuuuguacatt

SEQ ID NO: 120 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (5)..(5): 2'-O-Methyl nucleotide
  modified_base (14)..(14): 2'-O-Methyl nucleotide
  modified_base (20)..(21): 2'-deoxythymidine
  misc_feature (20)..(21): Phosphorothioate linkage
uguacaaagcgagcaccgctt

SEQ ID NO: 121 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (7)..(8): 2'-O-Methyl nucleotide
  modified_base (10)..(12): 2'-O-Methyl nucleotide
  modified_base (14)..(14): 2'-O-Methyl nucleotide
  modified_base (17)..(18): 2'-O-Methyl nucleotide
  modified_base (20)..(21): 2'-deoxythymidine
  misc_feature (20)..(21): Phosphorothioate linkage
ucgaagccauccguggccatt

SEQ ID NO: 122 - DNA, 21 bp, Artificial Sequence
  Description of Artificial Sequence: Synthetic oligonucleotide
  Description of Combined DNA/RNA Molecule: Synthetic oligonucleotide
  modified_base (5)..(5): 2'-O-Methyl nucleotide
  modified_base (20)..(21): 2'-deoxythymidine
  misc_feature (20)..(21): Phosphorothioate linkage
uggccacggauggcuucgatt

SEQ ID NO: 123 - DNA, 21 bp, Artificial Sequence
  Description of Artificial Sequence: Synthetic oligonucleotide
  Description of Combined DNA/RNA Molecule: Synthetic oligonucleotide
  modified_base (1)..(4): 2'-O-Methyl nucleotide
  modified_base (6)..(8): 2'-O-Methyl nucleotide
  modified_base (12)..(13): 2'-O-Methyl nucleotide
  modified_base (18)..(19): 2'-O-Methyl nucleotide
  modified_base (20)..(21): 2'-deoxythymidine
  misc_feature (20)..(21): Phosphorothioate linkage
uccuguccaaacuaaggcutt

SEQ ID NO: 124 - DNA, 21 bp, Artificial Sequence
  Description of Artificial Sequence: Synthetic oligonucleotide
  Description of Combined DNA/RNA Molecule: Synthetic oligonucleotide
  modified_base (6)..(6): 2'-O-Methyl nucleotide
  modified_base (15)..(15): 2'-O-Methyl nucleotide
  modified_base (20)..(21): 2'-deoxythymidine
  misc_feature (20)..(21): Phosphorothioate linkage
agccuuaguuuggacaggatt

SEQ ID NO: 125 - DNA, 21 bp, Artificial Sequence
  Description of Artificial Sequence: Synthetic oligonucleotide
  Description of Combined DNA/RNA Molecule: Synthetic oligonucleotide
  modified_base (1)..(3): 2'-O-Methyl nucleotide
  modified_base (5)..(6): 2'-O-Methyl nucleotide
  modified_base (9)..(9): 2'-O-Methyl nucleotide
  modified_base (11)..(11): 2'-O-Methyl nucleotide
  modified_base (13)..(15): 2'-O-Methyl nucleotide
  modified_base (19)..(19): 2'-O-Methyl nucleotide
  modified_base (20)..(21): 2'-deoxythymidine
  misc_feature (20)..(21): Phosphorothioate linkage
cccacugauacgccugagutt

SEQ ID NO: 126 - DNA, 21 bp, Artificial Sequence
  Description of Artificial Sequence: Synthetic oligonucleotide
  Description of Combined DNA/RNA Molecule: Synthetic oligonucleotide
  modified_base (4)..(4): 2'-O-Methyl nucleotide
  modified_base (10)..(10): 2'-O-Methyl nucleotide
  modified_base (13)..(13): 2'-O-Methyl nucleotide
  modified_base (20)..(21): 2'-deoxythymidine
  misc_feature (20)..(21): Phosphorothioate linkage
acucaggcguaucagugggtt

SEQ ID NO: 127 - DNA, 21 bp, Artificial Sequence
  Description of Artificial Sequence: Synthetic oligonucleotide
  Description of Combined DNA/RNA Molecule: Synthetic oligonucleotide
  modified_base (4)..(5): 2'-O-Methyl nucleotide
  modified_base (10)..(12): 2'-O-Methyl nucleotide
  modified_base (14)..(15): 2'-O-Methyl nucleotide
  modified_base (18)..(19): 2'-O-Methyl nucleotide
  modified_base (20)..(21): 2'-deoxythymidine
  misc_feature (20)..(21): Phosphorothioate linkage
aaacuaaggcucgccaguctt

SEQ ID NO: 128 - DNA, 21 bp, Artificial Sequence
  Description of Artificial Sequence: Synthetic oligonucleotide
  Description of Combined DNA/RNA Molecule: Synthetic oligonucleotide
  modified_base (14)..(14): 2'-O-Methyl nucleotide
  modified_base (20)..(21): 2'-deoxythymidine
  misc_feature (20)..(21): Phosphorothioate linkage
gacuggcgagccuuaguuutt

SEQ ID NO: 129 - DNA, 21 bp, Artificial Sequence
  Description of Artificial Sequence: Synthetic oligonucleotide
  Description of Combined DNA/RNA Molecule: Synthetic oligonucleotide
  modified_base (2)..(5): 2'-O-Methyl nucleotide
  modified_base (8)..(8): 2'-O-Methyl nucleotide
  modified_base (11)..(12): 2'-O-Methyl nucleotide
  modified_base (15)..(16): 2'-O-Methyl nucleotide
  modified_base (18)..(19): 2'-O-Methyl nucleotide
  modified_base (20)..(21): 2'-deoxythymidine
  misc_feature (20)..(21): Phosphorothioate linkage
accuugguaaccggcugcutt

SEQ ID NO: 130 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (11)..(11): 2'-O-Methyl nucleotide
  modified_base (14)..(14): 2'-O-Methyl nucleotide
  modified_base (20)..(21): 2'-deoxythymidine
  misc_feature (20)..(21): Phosphorothioate linkage
agcagccgguuaccaaggutt

SEQ ID NO: 131 - skipped

SEQ ID NO: 132 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (4)..(5): 2'-O-Methyl nucleotide
  modified_base (7)..(8): 2'-O-Methyl nucleotide
  modified_base (10)..(11): 2'-O-Methyl nucleotide
  modified_base (18)..(19): 2'-O-Methyl nucleotide
  modified_base (20)..(21): 2'-deoxythymidine
guaccacuaccagagaguutt

SEQ ID NO: 133 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): 2'-O-Methyl nucleotide
  modified_base (17)..(17): 2'-O-Methyl nucleotide
  modified_base (20)..(21): 2'-deoxythymidine
aacucucugguagugguactt

SEQ ID NO: 134 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (7)..(7): 2'-O-Methyl nucleotide
  modified_base (9)..(9): 2'-O-Methyl nucleotide
  modified_base (11)..(11): 2'-O-Methyl nucleotide
  modified_base (13)..(13): 2'-O-Methyl nucleotide
  modified_base (17)..(19): 2'-O-Methyl nucleotide
  modified_base (20)..(21): 2'-deoxythymidine
augaaguguguguaaaucctt

SEQ ID NO: 135 - DNA, 21 bp, Artificial Sequence
  Description of Artificial Sequence: Synthetic oligonucleotide
  Description of Combined DNA/RNA Molecule: Synthetic oligonucleotide
  modified_base (6)..(6): 2'-O-Methyl nucleotide
  modified_base (8)..(8): 2'-O-Methyl nucleotide
  modified_base (10)..(10): 2'-O-Methyl nucleotide
  modified_base (12)..(12): 2'-O-Methyl nucleotide
  modified_base (17)..(17): 2'-O-Methyl nucleotide
  modified_base (20)..(21): 2'-deoxythymidine
ggauuuacacacacuucautt

SEQ ID NO: 136 - DNA, 21 bp, Artificial Sequence
  Description of Artificial Sequence: Synthetic oligonucleotide
  Description of Combined DNA/RNA Molecule: Synthetic oligonucleotide
  modified_base (2)..(4): 2'-O-Methyl nucleotide
  modified_base (7)..(9): 2'-O-Methyl nucleotide
  modified_base (11)..(12): 2'-O-Methyl nucleotide
  modified_base (15)..(16): 2'-O-Methyl nucleotide
  modified_base (20)..(21): 2'-deoxythymidine
gcucagucugucaaccaggtt

SEQ ID NO: 137 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): 2'-O-Methyl nucleotide
  modified_base (20)..(21): 2'-deoxythymidine
ccugguugacagacugagctt

SEQ ID NO: 138 - DNA, 21 bp, Artificial Sequence
  Description of Artificial Sequence: Synthetic oligonucleotide
  Description of Combined DNA/RNA Molecule: Synthetic oligonucleotide
  modified_base (6)..(10): 2'-O-Methyl nucleotide
  modified_base (13)..(13): 2'-O-Methyl nucleotide
  modified_base (16)..(17): 2'-O-Methyl nucleotide
  modified_base (20)..(21): 2'-deoxythymidine
gaagaucuucaacaaccaatt

SEQ ID NO: 139 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): 2'-deoxythymidine
uugguuguugaagaucuuctt

SEQ ID NO: 140 - DNA, 21 bp, Artificial Sequence
  Description of Artificial Sequence: Synthetic oligonucleotide
  Description of Combined DNA/RNA Molecule: Synthetic oligonucleotide
  modified_base (4)..(4): 2'-O-Methyl nucleotide
  modified_base (9)..(9): 2'-O-Methyl nucleotide
  modified_base (11)..(11): 2'-O-Methyl nucleotide
  modified_base (13)..(13): 2'-O-Methyl nucleotide
  modified_base (15)..(15): 2'-O-Methyl nucleotide
  modified_base (19)..(19): 2'-O-Methyl nucleotide
  modified_base (20)..(21): 2'-deoxythymidine
agaugaaguguguguaaautt

SEQ ID NO: 141 - DNA, 21 bp, Artificial Sequence
  Description of Artificial Sequence: Synthetic oligonucleotide
  Description of Combined DNA/RNA Molecule: Synthetic oligonucleotide
  modified_base (4)..(4): 2'-O-Methyl nucleotide
  modified_base (6)..(6): 2'-O-Methyl nucleotide
  modified_base (8)..(8): 2'-O-Methyl nucleotide
  modified_base (10)..(10): 2'-O-Methyl nucleotide
  modified_base (15)..(15): 2'-O-Methyl nucleotide
  modified_base (20)..(21): 2'-deoxythymidine
auuuacacacacuucaucutt

SEQ ID NO: 142 - DNA, 21 bp, Artificial Sequence
  Description of Artificial Sequence: Synthetic oligonucleotide
  Description of Combined DNA/RNA Molecule: Synthetic oligonucleotide
  modified_base (3)..(5): 2'-O-Methyl nucleotide
  modified_base (11)..(15): 2'-O-Methyl nucleotide
  modified_base (18)..(18): 2'-O-Methyl nucleotide
  modified_base (20)..(21): 2'-deoxythymidine
aaccugaagaucuucaacatt

SEQ ID NO: 143 - DNA, 21 bp, Artificial Sequence
  Description of Artificial Sequence: Synthetic oligonucleotide
  Description of Combined DNA/RNA Molecule: Synthetic oligonucleotide
  modified_base (14)..(14): 2'-O-Methyl nucleotide
  modified_base (20)..(21): 2'-deoxythymidine
uguugaagaucuucagguutt

SEQ ID NO: 144 - DNA, 21 bp, Artificial Sequence
  Description of Artificial Sequence: Synthetic oligonucleotide
  Description of Combined DNA/RNA Molecule: Synthetic oligonucleotide
  modified_base (3)..(3): 2'-O-Methyl nucleotide
  modified_base (8)..(8): 2'-O-Methyl nucleotide
  modified_base (10)..(10): 2'-O-Methyl nucleotide
  modified_base (12)..(12): 2'-O-Methyl nucleotide
  modified_base (14)..(14): 2'-O-Methyl nucleotide
  modified_base (18)..(19): 2'-O-Methyl nucleotide
  modified_base (20)..(21): 2'-deoxythymidine
gaugaaguguguguaaauctt

SEQ ID NO: 145 - DNA, 21 bp, Artificial Sequence
  Description of Artificial Sequence: Synthetic oligonucleotide
  Description of Combined DNA/RNA Molecule: Synthetic oligonucleotide
  modified_base (5)..(5): 2'-O-Methyl nucleotide
  modified_base (7)..(7): 2'-O-Methyl nucleotide
  modified_base (9)..(9): 2'-O-Methyl nucleotide
  modified_base (11)..(11): 2'-O-Methyl nucleotide
  modified_base (16)..(16): 2'-O-Methyl nucleotide
  modified_base (20)..(21): 2'-deoxythymidine
gauuuacacacacuucauctt

SEQ ID NO: 146 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (7)..(11): 2'-O-Methyl nucleotide
  modified_base (14)..(14): 2'-O-Methyl nucleotide
  modified_base (17)..(18): 2'-O-Methyl nucleotide
  modified_base (20)..(21): 2'-deoxythymidine
ugaagaucuucaacaaccatt

SEQ ID NO: 147 - DNA, 21 bp, Artificial Sequence
  Description of Artificial Sequence: Synthetic oligonucleotide
  Description of Combined DNA/RNA Molecule: Synthetic oligonucleotide
  modified_base (18)..(18): 2'-O-Methyl nucleotide
  modified_base (20)..(21): 2'-deoxythymidine
ugguuguugaagaucuucatt

SEQ ID NO: 148 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (4)..(6): 2'-O-Methyl nucleotide
  modified_base (12)..(16): 2'-O-Methyl nucleotide
  modified_base (19)..(19): 2'-O-Methyl nucleotide
  modified_base (20)..(21): 2'-deoxythymidine
uaaccugaagaucuucaactt

SEQ ID NO: 149 - DNA, 21 bp, Artificial Sequence
  Description of Artificial Sequence: Synthetic oligonucleotide
  Description of Combined DNA/RNA Molecule: Synthetic oligonucleotide
  modified_base (13)..(13): 2'-O-Methyl nucleotide
  modified_base (18)..(18): 2'-O-Methyl nucleotide
  modified_base (20)..(21): 2'-deoxythymidine
guugaagaucuucagguuatt

SEQ ID NO: 150 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (8)..(12): 2'-O-Methyl nucleotide
  modified_base (15)..(15): 2'-O-Methyl nucleotide
  modified_base (18)..(19): 2'-O-Methyl nucleotide
  modified_base (20)..(21): 2'-deoxythymidine
cugaagaucuucaacaacctt

SEQ ID NO: 151 - DNA, 21 bp, Artificial Sequence
  Description of Artificial Sequence: Synthetic oligonucleotide
  Description of Combined DNA/RNA Molecule: Synthetic oligonucleotide
  modified_base (17)..(17): 2'-O-Methyl nucleotide
  modified_base (20)..(21): 2'-deoxythymidine
gguuguugaagaucuucagtt

SEQ ID NO: 152 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (6)..(6): 2'-O-Methyl nucleotide
  modified_base (8)..(8): 2'-O-Methyl nucleotide
  modified_base (10)..(10): 2'-O-Methyl nucleotide
  modified_base (12)..(12): 2'-O-Methyl nucleotide
  modified_base (16)..(18): 2'-O-Methyl nucleotide
  modified_base (20)..(21): 2'-deoxythymidine
ugaaguguguguaaauccgtt

SEQ ID NO: 153 - DNA, 21 bp, Artificial Sequence
  Description of Artificial Sequence: Synthetic oligonucleotide
  Description of Combined DNA/RNA Molecule: Synthetic oligonucleotide
  modified_base (7)..(7): 2'-O-Methyl nucleotide
  modified_base (9)..(9): 2'-O-Methyl nucleotide
  modified_base (11)..(11): 2'-O-Methyl nucleotide
  modified_base (13)..(13): 2'-O-Methyl nucleotide
  modified_base (18)..(18): 2'-O-Methyl nucleotide
  modified_base (20)..(21): 2'-deoxythymidine
cggauuuacacacacuucatt

SEQ ID NO: 154 - DNA, 21 bp, Artificial Sequence
  Description of Artificial Sequence: Synthetic oligonucleotide
  Description of Combined DNA/RNA Molecule: Synthetic oligonucleotide
  modified_base (2)..(4): 2'-O-Methyl nucleotide
  modified_base (10)..(14): 2'-O-Methyl nucleotide
  modified_base (17)..(17): 2'-O-Methyl nucleotide
  modified_base (20)..(21): 2'-deoxythymidine
accugaagaucuucaacaatt

SEQ ID NO: 155 - DNA, 21 bp, Artificial Sequence
  Description of Artificial Sequence: Synthetic oligonucleotide
  Description of Combined DNA/RNA Molecule: Synthetic oligonucleotide
  modified_base (15)..(15): 2'-O-Methyl nucleotide
  modified_base (20)..(21): 2'-deoxythymidine
uuguugaagaucuucaggutt

SEQ ID NO: 156 - DNA, 21 bp, Artificial Sequence
  Description of Artificial Sequence: Synthetic oligonucleotide
  Description of Combined DNA/RNA Molecule: Synthetic oligonucleotide
  modified_base (1)..(3): 2'-O-Methyl nucleotide
  modified_base (6)..(8): 2'-O-Methyl nucleotide
  modified_base (10)..(11): 2'-O-Methyl nucleotide
  modified_base (14)..(15): 2'-O-Methyl nucleotide
  modified_base (20)..(21): 2'-deoxythymidine
cucagucugucaaccagggtt

SEQ ID NO: 157 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): 2'-O-Methyl nucleotide
  modified_base (20)..(21): 2'-deoxythymidine
cccugguugacagacugagtt

SEQ ID NO: 158 - DNA, 21 bp, Artificial Sequence
  Description of Artificial Sequence: Synthetic oligonucleotide
  Description of Combined DNA/RNA Molecule: Synthetic oligonucleotide
  modified_base (1)..(2): 2'-O-Methyl nucleotide
  modified_base (5)..(7): 2'-O-Methyl nucleotide
  modified_base (9)..(10): 2'-O-Methyl nucleotide
  modified_base (13)..(14): 2'-O-Methyl nucleotide
  modified_base (19)..(19): 2'-O-Methyl nucleotide
  modified_base (20)..(21): 2'-deoxythymidine
ucagucugucaaccagggutt

SEQ ID NO: 159 - DNA, 21 bp, Artificial Sequence
  Description of Artificial Sequence: Synthetic oligonucleotide
  Description of Combined DNA/RNA Molecule: Synthetic oligonucleotide
  modified_base (12)..(12): 2'-O-Methyl nucleotide
  modified_base (20)..(21): 2'-deoxythymidine
acccugguugacagacugatt

SEQ ID NO: 160 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (6)..(9): 2'-O-Methyl nucleotide
  modified_base (11)..(12): 2'-O-Methyl nucleotide
  modified_base (16)..(17): 2'-O-Methyl nucleotide
  modified_base (19)..(19): 2'-O-Methyl nucleotide
  modified_base (20)..(21): 2'-deoxythymidine
uaagaucccaccaggcugutt

SEQ ID NO: 161 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-Methyl nucleotide
  modified_base (18)..(18): 2'-O-Methyl nucleotide
  modified_base (20)..(21): 2'-deoxythymidine
acagccuggugggaucuuatt

SEQ ID NO: 162 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-O-Methyl nucleotide
  modified_base (4)..(4): 2'-O-Methyl nucleotide
  modified_base (10)..(10): 2'-O-Methyl nucleotide
  modified_base (18)..(18): 2'-O-Methyl nucleotide
  modified_base (20)..(21): 2'-deoxythymidine
cagugaagauggagaaacatt

SEQ ID NO: 163 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): 2'-O-Methyl nucleotide
  modified_base (15)..(15): 2'-O-Methyl nucleotide
  modified_base (20)..(21): 2'-deoxythymidine
uguuucuccaucuucacugtt

SEQ ID NO: 164 - DNA, 21 bp, Artificial Sequence
  Description of Artificial Sequence: Synthetic oligonucleotide
  Description of Combined DNA/RNA Molecule: Synthetic oligonucleotide
  modified_base (1)..(3): 2'-O-Methyl nucleotide
  modified_base (9)..(13): 2'-O-Methyl nucleotide
  modified_base (16)..(16): 2'-O-Methyl nucleotide
  modified_base (19)..(19): 2'-O-Methyl nucleotide
  modified_base (20)..(21): 2'-deoxythymidine
ccugaagaucuucaacaactt

SEQ ID NO: 165 - DNA, 21 bp, Artificial Sequence
  Description of Artificial Sequence: Synthetic oligonucleotide
  Description of Combined DNA/RNA Molecule: Synthetic oligonucleotide
  modified_base (16)..(16): 2'-O-Methyl nucleotide
  modified_base (20)..(21): 2'-deoxythymidine
guuguugaagaucuucaggtt

SEQ ID NO: 166 - DNA, 21 bp, Artificial Sequence
  Description of Artificial Sequence: Synthetic oligonucleotide
  Description of Combined DNA/RNA Molecule: Synthetic oligonucleotide
  modified_base (3)..(5): 2'-O-Methyl nucleotide
  modified_base (8)..(10): 2'-O-Methyl nucleotide
  modified_base (12)..(13): 2'-O-Methyl nucleotide
  modified_base (16)..(17): 2'-O-Methyl nucleotide
  modified_base (20)..(21): 2'-deoxythymidine
ggcucagucugucaaccagtt

SEQ ID NO: 167 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): 2'-O-Methyl nucleotide
  modified_base (20)..(21): 2'-deoxythymidine
cugguugacagacugagcctt

SEQ ID NO: 168 - protein, 16 aa, Unknown
  Description of Unknown: Exemplary hydrophobic membrane translocation sequence peptide
AAVALLPAVLLALLAP

SEQ ID NO: 169 - protein, 11 aa, Unknown
  Description of Unknown: Exemplary hydrophobic membrane translocation sequence peptide analog
AALLPVLLAAP

SEQ ID NO: 170 - protein, 13 aa, Human immunodeficiency virus
GRKKRRQRRRPPQ

SEQ ID NO: 171 - protein, 16 aa, Drosophila sp.
RQIKIWFQNRRMKWKK

SEQ ID NO: 172 - DNA, 5927 bp, Homo sapiens
tcgtcggagcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgactggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgctaaaggcgatgctggtccccctggccctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccctggtcccatgggcccccctggattggctggaccccctggtgaatctggacgtgagggggctcctggtgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactggtcctgctggtcccgccggtcctgtcggccctgttggcgcccgtggccccgccggaccccaaggcccccgtggtgacaagggtgagacaggcgaacagggcgacagaggcataaagggtcaccgtggcttctctggcctccagggtccccctggccctcctggctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataa

SEQ ID NO: 173 - DNA, 4709 bp, Mus musculus
ctcgggacggagcaggaggcacgcggagtgaggccacgcatgagccgaagctaaccccccaccccagccgcaaagagtctacatgtctagggtctagacatgttcagctttgtggacctccggctcctgctcctcttaggggccactgccctcctgacgcatggccaagaagacatccctgaagtcagctgcatacacaatggcctaagggtccccaatggtgagacgtggaaacccgaggtatgcttgatctgtatctgccacaatggcacggctgtgtgcgatgacgtgcaatgcaatgaagaactggactgtcccaacccccaaagacgggagggcgagtgctgtgctttctgcccggaagaatacgtatcaccaaactcagaagatgtaggagtcgagggacccaagggagaccctggcccccaaggcccaaggggacccgttggcccccctggacgagatggcatccctggacagcctggacttcctggtcctcctggtccccctgggccccccggaccccctggccttggaggaaactttgcttcccagatgtcctatggctatgatgaaaaatcagctggagtttccgtgcctggccccatgggtccttctggtcctcgtggtctccctggcccccctggtgcacctggtccacaaggtttccaaggcccccctggtgaacctggcgagcctggcggttcaggtccaatgggtccccgaggtccccctggccctcctggcaagaatggagatgatggggaagctggcaagcccggccgtcctggtgagcgtggacctcctggacctcagggtgctcgtggattgcctggaacagctggcctccctggaatgaagggacaccgaggcttcagtggtttggatggtgccaaaggagatgctggtcctgctggtcctaagggagagcccggcagtcctggtgaaaacggagctcctggccagatgggtccccgaggtctgcccggtgagagaggtcgccctggacctcctggcactgctggtgctcgcggtaacgatggtgctgttggtgctgctggaccccctggtcccaccggccccactggccctcctggcttccctggtgcagttggtgctaagggtgaagctggtccccaaggagctagaggctctgaaggtccccagggtgtgcgtggtgagcccggaccccctggccctgctggtgctgccggccctgctggaaaccctggtgctgatggacaacctggcgctaaaggtgccaatggtgctcctggtattgctggtgctcctggcttccctggtgcccgaggcccctctggaccccagggccccagcggccctccaggtcccaagggtaacagtggtgaacctggtgctcctggcaacaaaggagacactggtgccaaaggagaacccggtgctactggagttcaaggtcccccaggccctgccggagaagaaggaaaacgaggagcccgtggtgagcctggaccttccggactgcctggacctcctggcgagcgtggtggacctggtagccgtggtttccctggtgctgatggtgttgctggccccaagggtccttccggtgaacgtggtgctcccggacctgctggtcccaaaggttctcctggtgaagctggtcgccccggtgaagctggtctccctggtgccaagggtctcactggcagtcctggcagccctggtcctgatggcaaaaccggcccccctggtcccgctggtcaagatggtcgccctggacccgcaggtcctcctggagcccgtggccaggctggtgtgatgggattccctggacctaagggtaccgctggagaacctggaaaggctggagagcgaggccttcccggaccccctggcgctgttggtcctgctggcaaagatggagaagctggagctcagggagcccctggccctgctggtcctgctggtgagagaggtgaacaaggtcccgctggctcccctggattccagggtcttcctggtcctgccggtcctcctggtgaagcaggcaagcctggtgaacagggtgttcctggagaccttggtgcccctggaccctctggcgcaagaggcgagagaggtttccctggtgaacgtggtgtacaaggtcccccaggtcctgctggtccccgaggaaacaatggtgcccccggcaacgatggtgccaagggtgatactggtgcccccggagctcccggtagccagggtgcccccggtcttcagggaatgcctggtgaacgtggtgcagctggtcttccaggtcctaagggtgacagaggtgatgctggtcccaaaggtgctgatggttctcctggtaaagatggtgcccgtggtctgactggtcccattggtcctcctggccctgctggtgcccctggtgacaagggtgaagctggtcccagtggtcctcccggtcccaccggagcccgtggtgctcccggagaccgtggtgaggctggtccccctggtcctgctggctttgccggcccccctggtgctgatggccaacctggtgcgaaaggtgaacctggtgatactggtgttaaaggtgatgctggtcctcctggccctgctggtcctgctggaccccccggccccattggtaacgttggtgctcctggacccaaaggtcctcgtggtgctgctggtccccctggtgctactggcttccctggtgctgctggccgtgtcggtccccctggtccctctggaaatgctggaccccctggccctcccggtcccgttggcaaagaagggggcaaaggtccccgtggtgagactggccctgctggacgtcctggtgaagttggtcccccaggtccccccggtcctgctggtgagaaaggatctcctggtgctgatggacctgctggctctcctggtacccctggacctcagggtattgctggacaacgtggtgtggtcggtcttcccggtcagagaggagaaagaggcttccctggtcttcctggcccctctggtgaacctggcaaacaaggtccttctggatcaagtggtgaacgcggtccccctggccccatggggccccctggattggctggtccccctggtgaatctggacgtgagggatcccctggtgctgaaggctcccctggaagggatggtgctcccggggccaagggtgaccgtggtgagactggccccgctggcccccctggtgcccctggtgctcccggtgctcccggccctgttggtcccgctggcaagaatggcgatcgtggtgagactggtcctgctggtcctgctggtcccattggccctgctggtgcccgtggccctgctggaccccaaggcccccgtggtgacaagggtgagacaggcgaacaaggtgacagaggcataaagggtcatcgtggcttctctggtctccagggtcctcctggttctcctggttctcctggtgaacaaggcccctctggagcttcaggtcctgcaggcccccggggtccccctggctctgctggttctcctggcaaagacggactcaacggtctccctggccccattggtccccctggtcctcgaggtcgcactggtgacagcggccctgctggtccccccggccctcctggaccccctggccctcctggacctcccagtggcggttatgacttcagcttcctgcctcagccacctcaagagaagtctcaagatggtggccgctactaccgggccgatgatgctaacgtggttcgtgaccgtgaccttgaggtggacaccaccctcaagagcctgagtcagcagattgagaacatccgcagccccgaaggcagccgcaagaaccctgcccgcacatgccgcgacctcaagatgtgccactctgactggaagagcggagagtactggatcgaccctaaccaaggctgcaacctggacgccatcaaggtctactgcaacatggagacaggtcagacctgtgtgttccctactcagccgtctgtgcctcagaagaactggtacatcagcccgaaccccaaggaaaagaagcacgtctggtttggagagagcatgaccgatggattcccgttcgagtacggaagcgagggctccgaccccgccgatgtcgctatccagctgaccttcctgcgcctaatgtccaccgaggcctcccagaacatcacctatcactgcaagaacagcgtagcctacatggaccagcagactggcaacctcaagaaggccctgctcctccagggatccaacgagatcgagctcagaggcgaaggcaacagtcgcttcacctacagcacccttgtggacggctgcacgagtcacaccggaacttggggcaagacagtcatcgaatacaaaaccaccaagacctcccgcctgcccatcatcgatgtggctcccttggacattggtgccccagaccaggaattcggactagacattggccctgcctgcttcgtgtaaactccctccaccccaatctggttccctcccacccagcccacttttccccaaccctggaaacagacgaacaacccaaactcaatttcccccaaaagccaaaaatatgggagataatttcacatggactttggaaaacattttttttcctttgcattcacctttcaaacttagtttttacctttgaccaactgaacgtgaccaaaaaccaaaagtgcattcaaccttaccaaaaaagaaaaaaaaaaaaa

SEQ ID NO: 174 - DNA, 2217 bp, Homo sapiens
ccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggaaaaaaaaaaaaaaaaaa

SEQ ID NO: 175 - DNA, 2094 bp, Mus musculus
cgccgccgccgccgcccttcgcgccccaggccgtccccctcctcctcccgccgcggatcctccagacagccaggcccccggccggggcaggggggacgccccttcggggcacccccggctctgagccgcactcggagtcggcctccgctgggagccggcaaaggagcagccgaggagccgtccgaggccccagagtctgagaccagccgccgccgcagggaggagggggaggaggagtgggaggagggacgagctggttgagagaagaggaaaaaagttttgagacttttccgctgctactgcaagtcagagacgtggggacttcttggcactgcgctgtctcgcaaggaggcaggacctgaggactccagacagccctgctcaccgtcgtggacactcgatcgctacccggcgttcctcagacgcccctattccggaccagccctcgggagccacaaaccccgcctcccgcgaagacttcaccccaaagctggggcgcaccccttgcacgccgccctccccccagcctgcctcttgagtccctcgcatcccaggaccctctctcccccgagaggcagatctccctcggacctgctggcagtagctcccctatttaagaacacccacttttggatctcagagagcgctcatctcgatttttaccctggtggtatactgagacaccttggtgtcagagcctcaccgcgactcctgctgctttctccctcaacctcaaattattcaggactatcacctacctttccttgggagaccccaccccacaagccctgcaggggcggggcctccgcatcccacctttgccgagggttcccgctctccgaagtgccgtggggcgccgcctcccccatgccgccctcggggctgcggctactgccgcttctgctcccactcccgtggcttctagtgctgacgcccgggaggccagccgcgggactctccacctgcaagaccatcgacatggagctggtgaaacggaagcgcatcgaagccatccgtggccagatcctgtccaaactaaggctcgccagtcccccaagccagggggaggtaccgcccggcccgctgcccgaggcggtgctcgctttgtacaacagcacccgcgaccgggtggcaggcgagagcgccgacccagagccggagcccgaagcggactactatgctaaagaggtcacccgcgtgctaatggtggaccgcaacaacgccatctatgagaaaaccaaagacatctcacacagtatatatatgttcttcaatacgtcagacattcgggaagcagtgcccgaacccccattgctgtcccgtgcagagctgcgcttgcagagattaaaatcaagtgtggagcaacatgtggaactctaccagaaatatagcaacaattcctggcgttaccttggtaaccggctgctgacccccactgatacgcctgagtggctgtcttttgacgtcactggagttgtacggcagtggctgaaccaaggagacggaatacagggctttcgattcagcgctcactgctcttgtgacagcaaagataacaaactccacgtggaaatcaacgggatcagccccaaacgtcggggcgacctgggcaccatccatgacatgaaccggcccttcctgctcctcatggccacccccctggaaagggcccagcacctgcacagctcacggcaccggagagccctggataccaactattgcttcagctccacagagaagaactgctgtgtgcggcagctgtacattgactttaggaaggacctgggttggaagtggatccacgagcccaagggctaccatgccaacttctgtctgggaccctgcccctatatttggagcctggacacacagtacagcaaggtccttgccctctacaaccaacacaacccgggcgcttcggcgtcaccgtgctgcgtgccgcaggctttggagccactgcccatcgtctactacgtgggtcgcaagcccaaggtggagcagttgtccaacatgattgtgcgctcctgcaagtgcagctgaagccccgccccgccccgcccctcccggcaggcccggccccgcccccgccccgcc

SEQ ID NO: 176 - DNA, 10531 bp, Homo sapiens
gggaggcggggcgggccgtaggcaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcggcccagggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgtta

SEQ ID NO: 177 - DNA, 10444 bp, Homo sapiens
gccgggaggcggggcgggccgtaggcaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcggcccagggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgtta

SEQ ID NO: 178 - DNA, 10384 bp, Homo sapiens
gcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgtta

SEQ ID NO: 179 - DNA, 2512 bp, Mus musculus
ggaggagcagctcgccaagcctgcagctcgcgagcgccgagcgagcctcccggagggtagatttaccgggctttttctgagtgtggattgttacctttggtaagaaaatgtcgtccatcttgccattcactccgccagtggtgaagagacttctgggatggaaaaaatcagccggtgggtctggaggagcaggtggtggagagcagaatggacaggaagaaaagtggtgtgaaaaagcagtgaaaagtctggtgaaaaagctaaagaaaacaggacggttagatgagcttgagaaagccatcaccactcagaattgcaatactaaatgtgtcaccataccaagcacttgctctgaaatttggggactgagtacagcaaatacggtagatcagtgggacacaacaggcctttacagcttctctgaacaaaccaggtctcttgatggccgtcttcaggtttcacaccggaaagggttgccacatgttatatattgccggctctggcgctggccggaccttcacagtcatcatgagctcaaggcaatcgaaaactgcgaatatgcttttaatctgaaaaaagatgaagtgtgtgtaaatccgtaccactaccagagagttgagaccccagtcttgcctccagtcttagtgcctcggcacacggagattctaacagaactgccgcccctggatgactacacccactccattccagaaaacacaaatttcccagcaggaattgagccacagagtaattacatcccagaaacaccaccacctggatatatcagtgaagatggagaaacaagtgaccaacagttgaaccaaagtatggacacaggctctccggctgaactgtctcctactactctctctcctgttaatcacagcttggatttgcagccagttacttactcggaacctgcattctggtgttcaatcgcatactatgaactaaaccagagggttggagagaccttccatgcgtcacagccctcgctcactgtagacggcttcacagacccatcaaactcggagaggttctgcttaggcttgctctccaacgttaaccgaaatgccactgtagaaatgacaagaagacatataggaaggggagtgcgcttgtattacataggtggggaagtgtttgctgagtgcctaagtgatagtgcaatctttgtgcagagccccaactgtaaccagagatacggctggcaccctgcaacagtgtgtaagatcccaccaggctgtaacctgaagatcttcaacaaccaagaatttgctgctcttctggctcagtctgtcaaccagggttttgaagccgtttatcagctaacccgaatgtgcaccataagaatgagttttgtgaagggctggggagcagaatatcggaggcagacagtaacaagtactccttgctggattgaacttcatctgaatggccctctgcagtggctggacaaagtattaactcagatgggatccccttcagtgcgatgctcaagcatgtcgtaaacccatcaaagactcgctgtaacagctcctccgtcgtagtattcatgtatgatcccgtggactgtttgctatccaaaaattccagagcaaaaacagcacttgaggtctcatcagttaaagcaccttgtggaatctgtttcctatatttgaatattagatgggaaaattagtgtctagaaatgccctccccagcggggaaaaagaagacttaaagacttaatgatgtcttgttgggcataagacagtatcccaaaggttattaataacagtagtagttgtgtacaggtaatgtgtccagacccagtattgcagtactatgctgtttgtatacattcttagtttgcataaatgaggtgtgtgtgctgcttcttggtctaggcaagcctttataaaattacagtatctaatctgttattcccacttctccgttatttttgtgtcttttttaatatataatatatatatatcaagattttcaaattatcatttagaagcagattttccttgtagaaactaatttttctgccttttaccaaaaataaacaaactcttgggggaagacaagtggattaacttggaagtccttgaccttcatgtgtccagtggatcttagcagtcgttcttttgtgagccttttctcctgagttgcattagaaggaaaccttactggaaccgtccaggctcctcatcccattcctgttctggttcagagcagtacagcagaatgacgtcgtgctaaacagttgcactgctggcttctgggttagttgtttctgagtccaggaaaggtttgtgtgggcagtaagtccttttgtctaataaccagacttcagcagatgataactgatgtgtataaccagttgttctgttgattaacttttgtctcaaacatgcacaggtggcagtataattattttcagggctattctagaatcatctcagtctgtttccttcttccaaagccagtctaataataaagtacctttctgtaaaggcagccg

SEQ ID NO: 180 - DNA, 5997 bp, Homo sapiens
aaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 181 - DNA, 5808 bp, Homo sapiens
acaaacatgtcttgcctgcaccctaggcaaacgtggaaaggcgcagctctggtacaccggaaagcatggtggatggggaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 182 - DNA, 5441 bp, Homo sapiens
cttctcagatcctttgcgggtagccctggcgtcccgcggagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 183 - DNA, 6256 bp, Homo sapiens
gcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctgaaaaaaaaaaaaaaaaaaaaaaaaa

SEQ ID NO: 184 - DNA, 5090 bp, Mus musculus
ggcggcacccaaacagctaccccgtgcggaaacccaaactttctactgccacttggagtctcgcggccgccgcctccgccccgcgcgtccggggcctgcccgtcagtccgtcggtccgcgtggagcagctcgggcgccgccgtgctcccgatccccgcagctgcagcgccgcagtcctggcccggacgcccgggcaagttctccagagttaaaagcgaagttcgggcgaggcgcgggccgagctgcctctgagcgcccccggcgtccccagtgcgcccagccccgccgggggcgccggtgacccttcggtgccagccatgtcgtccatcctgcccttcacccccccgatcgtgaagcgcctgctgggttggaagaagggcgagcagaacgggcaggaggagaagtggtgcgagaaggcggtcaagagcttggtgaagaagctcaagaagacggggcagttggacgagctggagaaggccatcaccacgcagaacgtgaacaccaagtgcattaccatccccaggtcactggatggtcggctgcaggtgtcccatcggaaggggctccctcacgttatctactgccgcctgtggcgatggcccgacctgcacagccaccatgaattacgggccatggagctctgtgagtttgccttcaacatgaagaaggatgaagtgtgtgtaaatccttaccactatcagagagtagagacgccagttctacctccagtgttggtgccacgccacaccgagatcccggccgagttccccccactggatgactacagccattccattcccgagaacactaacttccctgctggcattgagccccagagcaatattccagaaaccccacctcctggctacctgagtgaagatggagaaaccagtgaccaccagatgaaccacagcatggacgcaggttctccaaacctctccccgaatccgatgtccccagcacacaataacttggacctacagccagtcacctactgtgagccggccttctggtgctccatctcctactacgagctgaaccagcgagttggggagacattccacgcctcacagccatccatgacagtagatggcttcactgacccctccaactcggagcgcttctgcctgggcctactgtccaatgtcaaccggaatgcagccgtggaacttacaaggcgacacattgggagaggtgtgcggctctactacatcggaggggaggtctttgcggagtgcctcagtgacagtgctattttcgtccagtctcccaactgcaaccagcgctatggctggcacccggccactgtctgcaagatcccaccaggctgcaacctgaagatcttcaacaaccaggaatttgctgccctcctagctcagtctgtcaaccagggctttgaggctgtctaccagctgacgcgcatgtgcaccatccgtatgagcttcgtcaaaggctggggagcagagtacaggagacagacagtgaccagcaccccctgctggattgagctacacctgaatggacccttgcagtggcttgacaaggtcctcacccagatgggttccccgagcatccgctgttccagtgtgtcttagagacactaggagtaaagggagcgggttggggagggcgggcttggggaaaatgaccttggaagagaactccatccaacttggtcttgtcaaagaacaccgattccactcaactaaggcaccagcctgtttctgagaccacagaagaaaaccccagggatggatttatgaacagctgtgtctgctacatacacgtgcccctgtctgaaggccaagtgatggcttctgttctggtggcttgaactaacaggtggtgtatcgccacctgactccttgtttaatgacagaggtctgggatgtcacagtccaaaaggaaagtgcctttctccatggctggagtatggagtttacctttggagaagttgtaatggagcatgccctgtcccaccactctcagagagggtgtacctgtcaaactggatggcctacataggtactcccccctacccctaggatgcagagagacgggaacacgccggagggtagagctggggagaacccattcttccttggaaggatccgctgaaggtcagcgtataggtgatgtacagttcctaatatcacatcagtctcagagtgttcacaggaagcagcaagggcactcgtggagtatgtgtcctgggtgaggtggcaccacaccgaatgaatgcatctctgggagctggcaccacaaccctgatgtataggctgtgttggtttatggagacaagttgcatcaatgaattcacctagcataggctctttgaaatgtcctctgtttgataaaaaacaatcctgggtacgtatgttggctggaaaaccacaatggaccctgccactgcttcttgccctgaggtttggaagctgagagttatagaagccaattcaccaggaggtaagacatcccaggctgacatgggcaaatgaaaagggctattaaaatttttttacaccttggaaaattgcaggcttggtgcagagcgctctgtcatcttcaccctgggatgtaggattacctagctatggtaaaggattgccacagcaaactgtgacactgtgtaatgagcactgttcccagcggcaattacagagaaaacgagtgtaaattatttcaactggaaaaaagtccctttcttggctgttttagaacagggtacacaggatcgccacctgcaactggtactcgcttcttggctgctgcttctgttgtgaaaagacgagcccatgtttctgcatggatttcccatggaagtcctgtcctgctacagaggggaagaaagtgtaccctccaatgtgataaatcttctgatgcccccagactcttggagcacatcctggtgcccctcctgcaggagcctgtggcatatttccagctgggcatgctgatcctccttgagacacagatgcctgtgtgagtctccgttgatacaattctgaacccctcaggttctctgaaagggcacagaccatgggcgtgaacattgtgccgtacctgagatggtctgtggactgctgcttcagacacacgagtcctcggaactgcctggctgcctgtcacgcatgctctgagtcagaacacaccaacgctctgctgtggctcctagggaagcattcatggtcctctgttatcagcaggggtttatgtcacttgctgtccggtttcctaggggcttcctgtgccccttccccagctatcctccaggtggctagggacagtctattctgctgcaactggaaagtagagggaaccggcactgctcagagcagatggcggcttctggaggcacacagtgggagtacaccccttcatgttattggccagttgctggagaatgctgtaggagaaaattctaggcaggtctactcttggcatccctgagagtcaaaggcttggagtctaggaaaggtcacaccatgatggagaacacaggtcatttgggtacgtgtaatcaaagtgccctcccaaatcagttctccttttcgtatgaacagcatctctacttttaaagaggagttgaggatcgagaagatgacagtgcagcagtgggtgtggcctgactacatgtgctgttccagccctgggtgcccactgacaccgacccccaggcagaggcctttgtcttcagcactcctgagaagttggctctttaccccttctcctctgctgcccctccttcctgctggttcaggtagccccagccacgtgggttagagtcctgtgctggcctgccatggcagctggctaccttccagaccaactgtagagatacctggcattttgaagaaagcctagactggagagcagggcctctcttgggaaggacacaaggcgggcaaggctgctggcagacttctccactgacctgagtgtgctttttttttcccctaaatgtattgcatcaagcctcagtgcttatggagtgcagtggtcttcatcttccccaacttgcttctcagagctgggatgtattccagagcctgatgtttttattcaaaccacagaaaagttttctttaagtagcctgtgcagtcatgcatgtgcctgagttgtctggagcagaggcaaacatctgacttcattcttagccccaagctgccatttctgagtccttgagaggctgagaaggctctagctttgtactgtattcttactgtgtgactagatgcgtgagcgctttacattagaaggaacctggttagagctcgctcctcctgtctttgtgtggcatttgtgttccattaccggcccctttaagtaacggccttcacagcaccttcccagtgggtagaaagccacacaccaggatgtgggtcaaccatgaagatgtggcattgcagacgggggaacatgtggatgcatggctatcgccctgaacagtccctgcagctacttgtgttaacacagaactgatgtttagcattctgccgctttcgtatttatgtaacaattccttaaagccattcaaatggctaactatttaatttctttaggacagttgtaaaggtctctctcctgaggacaatgacttggaagaactggggcacagccagtcccagacactggtggaggctgcagtgactttttttggctcaagatccacaagcattagagtagactgggccaacaagtcaacaagtggtggcgtgtgcaaacgggctgccctagtcaagcccagtcccttcaacagtatgtctgatgcaccacaggccctccctactggaagtgggaacttcaaatggaaattggagccatcttttatcccagaagcctttgctgctgccagggcaagtgggctggtgtggactcttgtttaggaggctgaggttcttgtcactccttagccagccaggcctttagtgtctttgtaaaaagcatgtatttatagtgttttagatttttctaacttttgtatcttacagcattgtaccccattgttaaagagccgtgtcccctcttcttataaacgcccttctaataaacttttcaccgtaaagctcctgagacaggagcacagtctg

SEQ ID NO: 185 - RNA, 19 nt, Artificial Sequence
  Description of Artificial Sequence: Synthetic oligonucleotide
ucgucggagcagacgggag

SEQ ID NO: 186 - RNA, 19 nt, Artificial Sequence
  Description of Artificial Sequence: Synthetic oligonucleotide
cucccgucugcuccgacga

SEQ ID NO: 187 - RNA, 19 nt, Artificial Sequence
  Description of Artificial Sequence: Synthetic oligonucleotide
cgucggagcagacgggagu

SEQ ID NO: 188 - RNA, 19 nt, Artificial Sequence
  Description of Artificial Sequence: Synthetic oligonucleotide
acucccgucugcuccgacg

SEQ ID NO: 189 - RNA, 19 nt, Artificial Sequence
  Description of Artificial Sequence: Synthetic oligonucleotide
gucggagcagacgggaguu

SEQ ID NO: 190 - RNA, 19 nt, Artificial Sequence
  Description of Artificial Sequence: Synthetic oligonucleotide
aacucccgucugcuccgac

SEQ ID NO: 191 - RNA, 19 nt, Artificial Sequence
  Description of Artificial Sequence: Synthetic oligonucleotide
ucggagcagacgggaguuu

SEQ ID NO: 192 - RNA, 19 nt, Artificial Sequence
  Description of Artificial Sequence: Synthetic oligonucleotide
aaacucccgucugcuccga

SEQ ID NO: 193 - RNA, 19 nt, Artificial Sequence
  Description of Artificial Sequence: Synthetic oligonucleotide
cggagcagacgggaguuuc

SEQ ID NO: 194 - RNA, 19 nt, Artificial Sequence
  Description of Artificial Sequence: Synthetic oligonucleotide
gaaacucccgucugcuccg

SEQ ID NO: 195 - RNA, 19 nt, Artificial Sequence
  Description of Artificial Sequence: Synthetic oligonucleotide
ggagcagacgggaguuucu

SEQ ID NO: 196 - RNA, 19 nt, Artificial Sequence
  Description of Artificial Sequence: Synthetic oligonucleotide
agaaacucccgucugcucc

SEQ ID NO: 197 - RNA, 19 nt, Artificial Sequence
  Description of Artificial Sequence: Synthetic oligonucleotide
cgggaguuucuccucgggg

SEQ ID NO: 198 - RNA, 19 nt, Artificial Sequence
  Description of Artificial Sequence: Synthetic oligonucleotide
ccccgaggagaaacucccg

SEQ ID NO: 199 - RNA, 19 nt, Artificial Sequence
  Description of Artificial Sequence: Synthetic oligonucleotide
ggaguuucuccucgggguc

SEQ ID NO: 200 - RNA, 19 nt, Artificial Sequence
  Description of Artificial Sequence: Synthetic oligonucleotide
gaccccgaggagaaacucc

SEQ ID NO: 201 - RNA, 19 nt, Artificial Sequence
  Description of Artificial Sequence: Synthetic oligonucleotide
gaguuucuccucggggucg

SEQ ID NO: 202 - RNA, 19 nt, Artificial Sequence
  Description of Artificial Sequence: Synthetic oligonucleotide
cgaccccgaggagaaacuc

SEQ ID NO: 203 - RNA, 19 nt, Artificial Sequence
  Description of Artificial Sequence: Synthetic oligonucleotide
aguuucuccucggggucgg

SEQ ID NO: 204 - RNA, 19 nt, Artificial Sequence
  Description of Artificial Sequence: Synthetic oligonucleotide
ccgaccccgaggagaaacu

SEQ ID NO: 205 - RNA, 19 nt, Artificial Sequence
  Description of Artificial Sequence: Synthetic oligonucleotide
uucuccucggggucggagc

SEQ ID NO: 206 - RNA, 19 nt, Artificial Sequence
  Description of Artificial Sequence: Synthetic oligonucleotide
gcuccgaccccgaggagaa

SEQ ID NO: 207 - RNA, 19 nt, Artificial Sequence
  Description of Artificial Sequence: Synthetic oligonucleotide
ucuccucggggucggagca

SEQ ID NO: 208 - RNA, 19 nt, Artificial Sequence
  Description of Artificial Sequence: Synthetic oligonucleotide
ugcuccgaccccgaggaga

SEQ ID NO: 209 - RNA, 19 nt, Artificial Sequence
  Description of Artificial Sequence: Synthetic oligonucleotide
cuccucggggucggagcag

SEQ ID NO: 210 - RNA, 19 nt, Artificial Sequence
  Description of Artificial Sequence: Synthetic oligonucleotide
cugcuccgaccccgaggag

SEQ ID NO: 211 - RNA, 19 nt, Artificial Sequence
  Description of Artificial Sequence: Synthetic oligonucleotide
ccucggggucggagcagga

SEQ ID NO: 212 - RNA, 19 nt, Artificial Sequence
  Description of Artificial Sequence: Synthetic oligonucleotide
uccugcuccgaccccgagg

SEQ ID NO: 213 - RNA, 19 nt, Artificial Sequence
  Description of Artificial Sequence: Synthetic oligonucleotide
ggagcaggaggcacgcgga

SEQ ID NO: 214 - RNA, 19 nt, Artificial Sequence
  Description of Artificial Sequence: Synthetic oligonucleotide
uccgcgugccuccugcucc

SEQ ID NO: 215 - RNA, 19 nt, Artificial Sequence
  Description of Artificial Sequence: Synthetic oligonucleotide
gcaggaggcacgcggagug

SEQ ID NO: 216 - RNA, 19 nt, Artificial Sequence
  Description of Artificial Sequence: Synthetic oligonucleotide
cacuccgcgugccuccugc

SEQ ID NO: 217 - RNA, 19 nt, Artificial Sequence
  Description of Artificial Sequence: Synthetic oligonucleotide
ggaggcacgcggaguguga

SEQ ID NO: 218 - RNA, 19 nt, Artificial Sequence
  Description of Artificial Sequence: Synthetic oligonucleotide
ucacacuccgcgugccucc

SEQ ID NO: 219 - RNA, 19 nt, Artificial Sequence
  Description of Artificial Sequence: Synthetic oligonucleotide
gaggcacgcggagugugag

SEQ ID NO: 220 - RNA, 19 nt, Artificial Sequence
  Description of Artificial Sequence: Synthetic oligonucleotide
cucacacuccgcgugccuc

SEQ ID NO: 221 - RNA, 19 nt, Artificial Sequence
  Description of Artificial Sequence: Synthetic oligonucleotide
cacgcggagugugaggcca

SEQ ID NO: 222 - RNA, 19 nt, Artificial Sequence
  Description of Artificial Sequence: Synthetic oligonucleotide
uggccucacacuccgcgug

SEQ ID NO: 223 - RNA, 19 nt, Artificial Sequence
  Description of Artificial Sequence: Synthetic oligonucleotide
acgcggagugugaggccac

SEQ ID NO: 224 - RNA, 19 nt, Artificial Sequence
  Description of Artificial Sequence: Synthetic oligonucleotide
guggccucacacuccgcgu

SEQ ID NO: 225 - RNA, 19 nt, Artificial Sequence
  Description of Artificial Sequence: Synthetic oligonucleotide
cgcggagugugaggccacg

SEQ ID NO: 226 - RNA, 19 nt, Artificial Sequence
  Description of Artificial Sequence: Synthetic oligonucleotide
cguggccucacacuccgcg

SEQ ID NO: 227 - RNA, 19 nt, Artificial Sequence
  Description of Artificial Sequence: Synthetic oligonucleotide
gagugugaggccacgcaug

SEQ ID NO: 228 - RNA, 19 nt, Artificial Sequence
  Description of Artificial Sequence: Synthetic oligonucleotide
caugcguggccucacacuc

SEQ ID NO: 229 - RNA, 19 nt, Artificial Sequence
  Description of Artificial Sequence: Synthetic oligonucleotide
agugugaggccacgcauga

SEQ ID NO: 230 - RNA, 19 nt, Artificial Sequence
  Description of Artificial Sequence: Synthetic oligonucleotide
ucaugcguggccucacacu

SEQ ID NO: 231 - RNA, 19 nt, Artificial Sequence
  Description of Artificial Sequence: Synthetic oligonucleotide
gugugaggccacgcaugag

SEQ ID NO: 232 - RNA, 19 nt, Artificial Sequence
  Description of Artificial Sequence: Synthetic oligonucleotide
cucaugcguggccucacac

SEQ ID NO: 233 - RNA, 19 nt, Artificial Sequence
  Description of Artificial Sequence: Synthetic oligonucleotide
ugugaggccacgcaugagc

SEQ ID NO: 234 - RNA, 19 nt, Artificial Sequence
  Description of Artificial Sequence: Synthetic oligonucleotide
gcucaugcguggccucaca

SEQ ID NO: 235 - RNA, 19 nt, Artificial Sequence
  Description of Artificial Sequence: Synthetic oligonucleotide
ugaggccacgcaugagcgg

SEQ ID NO: 236 - RNA, 19 nt, Artificial Sequence
  Description of Artificial Sequence: Synthetic oligonucleotide
ccgcucaugcguggccuca

SEQ ID NO: 237 - RNA, 19 nt, Artificial Sequence
  Description of Artificial Sequence: Synthetic oligonucleotide
gaggccacgcaugagcgga

SEQ ID NO: 238 - RNA, 19 nt, Artificial Sequence
  Description of Artificial Sequence: Synthetic oligonucleotide
uccgcucaugcguggccuc

SEQ ID NO: 239 - RNA, 19 nt, Artificial Sequence
  Description of Artificial Sequence: Synthetic oligonucleotide
acgcaugagcggacgcuaa

SEQ ID NO: 240 - RNA, 19 nt, Artificial Sequence
  Description of Artificial Sequence: Synthetic oligonucleotide
uuagcguccgcucaugcgu

SEQ ID NO: 241 - RNA, 19 nt, Artificial Sequence
  Description of Artificial Sequence: Synthetic oligonucleotide
cgcaugagcggacgcuaac

SEQ ID NO: 242 - RNA, 19 nt, Artificial Sequence
  Description of Artificial Sequence: Synthetic oligonucleotide
guuagcguccgcucaugcg

SEQ ID NO: 243 - RNA, 19 nt, Artificial Sequence
  Description of Artificial Sequence: Synthetic oligonucleotide
gcaugagcggacgcuaacc

SEQ ID NO: 244 - RNA, 19 nt, Artificial Sequence
  Description of Artificial Sequence: Synthetic oligonucleotide
gguuagcguccgcucaugc

SEQ ID NO: 245 - RNA, 19 nt, Artificial Sequence
  Description of Artificial Sequence: Synthetic oligonucleotide
caugagcggacgcuaaccc

SEQ ID NO: 246 - RNA, 19 nt, Artificial Sequence
  Description of Artificial Sequence: Synthetic oligonucleotide
ggguuagcguccgcucaug

SEQ ID NO: 247 - RNA, 19 nt, Artificial Sequence
  Description of Artificial Sequence: Synthetic oligonucleotide
augagcggacgcuaacccc

SEQ ID NO: 248 - RNA, 19 nt, Artificial Sequence
  Description of Artificial Sequence: Synthetic oligonucleotide
gggguuagcguccgcucau

SEQ ID NO: 249 - RNA, 19 nt, Artificial Sequence
  Description of Artificial Sequence: Synthetic oligonucleotide
ugagcggacgcuaaccccc

SEQ ID NO: 250 - RNA, 19 nt, Artificial Sequence
  Description of Artificial Sequence: Synthetic oligonucleotide
ggggguuagcguccgcuca

SEQ ID NO: 251 - RNA, 19 nt, Artificial Sequence
  Description of Artificial Sequence: Synthetic oligonucleotide
gagcggacgcuaacccccu

SEQ ID NO: 252 - RNA, 19 nt, Artificial Sequence
  Description of Artificial Sequence: Synthetic oligonucleotide
aggggguuagcguccgcuc

SEQ ID NO: 253 - RNA, 19 nt, Artificial Sequence
  Description of Artificial Sequence: Synthetic oligonucleotide
agcggacgcuaacccccuc

SEQ ID NO: 254 - RNA, 19 nt, Artificial Sequence
  Description of Artificial Sequence: Synthetic oligonucleotide
gaggggguuagcguccgcu

SEQ ID NO: 255 - RNA, 19 nt, Artificial Sequence
  Description of Artificial Sequence: Synthetic oligonucleotide
acgcuaacccccuccccag

SEQ ID NO: 256 - RNA, 19 nt, Artificial Sequence
  Description of Artificial Sequence: Synthetic oligonucleotide
cuggggaggggguuagcgu

SEQ ID NO: 257 - RNA, 19 nt, Artificial Sequence
  Description of Artificial Sequence: Synthetic oligonucleotide
agccacaaagagucuacau

SEQ ID NO: 258 - RNA, 19 nt, Artificial Sequence
  Description of Artificial Sequence: Synthetic oligonucleotide
auguagacucuuuguggcu

SEQ ID NO: 259 - RNA, 19 nt, Artificial Sequence
  Description of Artificial Sequence: Synthetic oligonucleotide
cacaaagagucuacauguc

SEQ ID NO: 260 - RNA, 19 nt, Artificial Sequence
  Description of Artificial Sequence: Synthetic oligonucleotide
gacauguagacucuuugug

SEQ ID NO: 261 - RNA, 19 nt, Artificial Sequence
  Description of Artificial Sequence: Synthetic oligonucleotide
acaaagagucuacaugucu

SEQ ID NO: 262 - RNA, 19 nt, Artificial Sequence
  Description of Artificial Sequence: Synthetic oligonucleotide
agacauguagacucuuugu

SEQ ID NO: 263 - RNA, 19 nt, Artificial Sequence
  Description of Artificial Sequence: Synthetic oligonucleotide
gagucuacaugucuagggu

SEQ ID NO: 264 - RNA, 19 nt, Artificial Sequence
  Description of Artificial Sequence: Synthetic oligonucleotide
acccuagacauguagacuc

SEQ ID NO: 265 - RNA, 19 nt, Artificial Sequence
  Description of Artificial Sequence: Synthetic oligonucleotide
agucuacaugucuaggguc

SEQ ID NO: 266 - RNA, 19 nt, Artificial Sequence
  Description of Artificial Sequence: Synthetic oligonucleotide
gacccuagacauguagacu

SEQ ID NO: 267 - RNA, 19 nt, Artificial Sequence
  Description of Artificial Sequence: Synthetic oligonucleotide
gucuacaugucuagggucu

SEQ ID NO: 268 - RNA, 19 nt, Artificial Sequence
  Description of Artificial Sequence: Synthetic oligonucleotide
agacccuagacauguagac

SEQ ID NO: 269 - RNA, 19 nt, Artificial Sequence
  Description of Artificial Sequence: Synthetic oligonucleotide
ucuacaugucuagggucua

SEQ ID NO: 270 - RNA, 19 nt, Artificial Sequence
  Description of Artificial Sequence: Synthetic oligonucleotide
uagacccuagacauguaga

SEQ ID NO: 271 - RNA, 19 nt, Artificial Sequence
  Description of Artificial Sequence: Synthetic oligonucleotide
cuacaugucuagggucuag

SEQ ID NO: 272 - RNA, 19 nt, Artificial Sequence
  Description of Artificial Sequence: Synthetic oligonucleotide
cuagacccuagacauguag

SEQ ID NO: 273 - RNA, 19 nt, Artificial Sequence
  Description of Artificial Sequence: Synthetic oligonucleotide
uacaugucuagggucuaga

SEQ ID NO: 274 - RNA, 19 nt, Artificial Sequence
  Description of Artificial Sequence: Synthetic oligonucleotide
ucuagacccuagacaugua

SEQ ID NO: 275 - RNA, 19 nt, Artificial Sequence
  Description of Artificial Sequence: Synthetic oligonucleotide
acaugucuagggucuagac

SEQ ID NO: 276 - RNA, 19 nt, Artificial Sequence
  Description of Artificial Sequence: Synthetic oligonucleotide
gucuagacccuagacaugu

SEQ ID NO: 277 - RNA, 19 nt, Artificial Sequence
  Description of Artificial Sequence: Synthetic oligonucleotide
caugucuagggucuagaca

SEQ ID NO: 278 - RNA, 19 nt, Artificial Sequence
  Description of Artificial Sequence: Synthetic oligonucleotide
ugucuagacccuagacaug

SEQ ID NO: 279 - RNA, 19 nt, Artificial Sequence
  Description of Artificial Sequence: Synthetic oligonucleotide
augucuagggucuagacau

SEQ ID NO: 280 - RNA, 19 nt, Artificial Sequence
  Description of Artificial Sequence: Synthetic oligonucleotide
augucuagacccuagacau

SEQ ID NO: 281 - RNA, 19 nt, Artificial Sequence
  Description of Artificial Sequence: Synthetic oligonucleotide
ugucuagggucuagacaug

SEQ ID NO: 282 - RNA, 19 nt, Artificial Sequence
  Description of Artificial Sequence: Synthetic oligonucleotide
caugucuagacccuagaca

SEQ ID NO: 283 - RNA, 19 nt, Artificial Sequence
  Description of Artificial Sequence: Synthetic oligonucleotide
gucuagggucuagacaugu

SEQ ID NO: 284 - RNA, 19 nt, Artificial Sequence
  Description of Artificial Sequence: Synthetic oligonucleotide
acaugucuagacccuagac

SEQ ID NO: 285 - RNA, 19 nt, Artificial Sequence
  Description of Artificial Sequence: Synthetic oligonucleotide
ucuagggucuagacauguu

SEQ ID NO: 286 - RNA, 19 nt, Artificial Sequence
  Description of Artificial Sequence: Synthetic oligonucleotide
aacaugucuagacccuaga

SEQ ID NO: 287 - RNA, 19 nt, Artificial Sequence
  Description of Artificial Sequence: Synthetic oligonucleotide
ggucuagacauguucagcu

SEQ ID NO: 288 - RNA, 19 nt, Artificial Sequence
  Description of Artificial Sequence: Synthetic oligonucleotide
agcugaacaugucuagacc

SEQ ID NO: 289 - RNA, 19 nt, Artificial Sequence
  Description of Artificial Sequence: Synthetic oligonucleotide
gucuagacauguucagcuu

SEQ ID NO: 290 - RNA, 19 nt, Artificial Sequence
  Description of Artificial Sequence: Synthetic oligonucleotide
aagcugaacaugucuagac

SEQ ID NO: 291 - RNA, 19 nt, Artificial Sequence
  Description of Artificial Sequence: Synthetic oligonucleotide
ucuagacauguucagcuuu

SEQ ID NO: 292 - RNA, 19 nt, Artificial Sequence
  Description of Artificial Sequence: Synthetic oligonucleotide
aaagcugaacaugucuaga

SEQ ID NO: 293 - RNA, 19 nt, Artificial Sequence
  Description of Artificial Sequence: Synthetic oligonucleotide
cagcuuuguggaccuccgg

SEQ ID NO: 294 - RNA, 19 nt, Artificial Sequence
  Description of Artificial Sequence: Synthetic oligonucleotide
ccggagguccacaaagcug

SEQ ID NO: 295 - RNA, 19 nt, Artificial Sequence
  Description of Artificial Sequence: Synthetic oligonucleotide
agcuuuguggaccuccggc

SEQ ID NO: 296 - RNA, 19 nt, Artificial Sequence
  Description of Artificial Sequence: Synthetic oligonucleotide
gccggagguccacaaagcu

SEQ ID NO: 297 - RNA, 19 nt, Artificial Sequence
  Description of Artificial Sequence: Synthetic oligonucleotide
cuuuguggaccuccggcuc

SEQ ID NO: 298 - RNA, 19 nt, Artificial Sequence
  Description of Artificial Sequence: Synthetic oligonucleotide
gagccggagguccacaaag

SEQ ID NO: 299 - RNA, 19 nt, Artificial Sequence
  Description of Artificial Sequence: Synthetic oligonucleotide
uuuguggaccuccggcucc

SEQ ID NO: 300 - RNA, 19 nt, Artificial Sequence
  Description of Artificial Sequence: Synthetic oligonucleotide
ggagccggagguccacaaa

SEQ ID NO: 301 - RNA, 19 nt, Artificial Sequence
  Description of Artificial Sequence: Synthetic oligonucleotide
uccugcuccucuuagcggc

SEQ ID NO: 302 - RNA, 19 nt, Artificial Sequence
  Description of Artificial Sequence: Synthetic oligonucleotide
gccgcuaagaggagcagga

SEQ ID NO: 303 - RNA, 19 nt, Artificial Sequence
  Description of Artificial Sequence: Synthetic oligonucleotide
ccugcuccucuuagcggcc

SEQ ID NO: 304 - RNA, 19 nt, Artificial Sequence
  Description of Artificial Sequence: Synthetic oligonucleotide
ggccgcuaagaggagcagg

SEQ ID NO: 305 - RNA, 19 nt, Artificial Sequence
  Description of Artificial Sequence: Synthetic oligonucleotide
cugcuccucuuagcggcca

SEQ ID NO: 306 - RNA, 19 nt, Artificial Sequence
  Description of Artificial Sequence: Synthetic oligonucleotide
uggccgcuaagaggagcag

SEQ ID NO: 307 - RNA, 19 nt, Artificial Sequence
  Description of Artificial Sequence: Synthetic oligonucleotide
ugcuccucuuagcggccac

SEQ ID NO: 308 - RNA, 19 nt, Artificial Sequence
  Description of Artificial Sequence: Synthetic oligonucleotide
guggccgcuaagaggagca

SEQ ID NO: 309 - RNA, 19 nt, Artificial Sequence
  Description of Artificial Sequence: Synthetic oligonucleotide
uccucuuagcggccaccgc

SEQ ID NO: 310 - RNA, 19 nt, Artificial Sequence
  Description of Artificial Sequence: Synthetic oligonucleotide
gcgguggccgcuaagagga

SEQ ID NO: 311 - RNA, 19 nt, Artificial Sequence
  Description of Artificial Sequence: Synthetic oligonucleotide
ccucuuagcggccaccgcc

SEQ ID NO: 312 - RNA, 19 nt, Artificial Sequence
  Description of Artificial Sequence: Synthetic oligonucleotide
ggcgguggccgcuaagagg

SEQ ID NO: 313 - RNA, 19 nt, Artificial Sequence
  Description of Artificial Sequence: Synthetic oligonucleotide
cucuuagcggccaccgccc

SEQ ID NO: 314 - RNA, 19 nt, Artificial Sequence
  Description of Artificial Sequence: Synthetic oligonucleotide
gggcgguggccgcuaagag

SEQ ID NO: 315 - RNA, 19 nt, Artificial Sequence
  Description of Artificial Sequence: Synthetic oligonucleotide
ucuuagcggccaccgcccu

SEQ ID NO: 316 - RNA, 19 nt, Artificial Sequence
  Description of Artificial Sequence: Synthetic oligonucleotide
agggcgguggccgcuaaga

SEQ ID NO: 317 - RNA, 19 nt, Artificial Sequence
  Description of Artificial Sequence: Synthetic oligonucleotide
cggccaccgcccuccugac

SEQ ID NO: 318 - RNA, 19 nt, Artificial Sequence
  Description of Artificial Sequence: Synthetic oligonucleotide
gucaggagggcgguggccg

SEQ ID NO: 319 - RNA, 19 nt, Artificial Sequence
  Description of Artificial Sequence: Synthetic oligonucleotide
ggccaccgcccuccugacg

SEQ ID NO: 320 - RNA, 19 nt, Artificial Sequence
  Description of Artificial Sequence: Synthetic oligonucleotide
cgucaggagggcgguggcc

SEQ ID NO: 321 - RNA, 19 nt, Artificial Sequence
  Description of Artificial Sequence: Synthetic oligonucleotide
gccaccgcccuccugacgc

SEQ ID NO: 322 - RNA, 19 nt, Artificial Sequence
  Description of Artificial Sequence: Synthetic oligonucleotide
gcgucaggagggcgguggc

SEQ ID NO: 323 - RNA, 19 nt, Artificial Sequence
  Description of Artificial Sequence: Synthetic oligonucleotide
accgcccuccugacgcacg

SEQ ID NO: 324 - RNA, 19 nt, Artificial Sequence
  Description of Artificial Sequence: Synthetic oligonucleotide
cgugcgucaggagggcggu

SEQ ID NO: 325 - RNA, 19 nt, Artificial Sequence
  Description of Artificial Sequence: Synthetic oligonucleotide
ccgcccuccugacgcacgg

SEQ ID NO: 326 - RNA, 19 nt, Artificial Sequence
  Description of Artificial Sequence: Synthetic oligonucleotide
ccgugcgucaggagggcgg

SEQ ID NO: 327 - RNA, 19 nt, Artificial Sequence
  Description of Artificial Sequence: Synthetic oligonucleotide
cgcccuccugacgcacggc

SEQ ID NO: 328 - RNA, 19 nt, Artificial Sequence
  Description of Artificial Sequence: Synthetic oligonucleotide
gccgugcgucaggagggcg

SEQ ID NO: 329 - RNA, 19 nt, Artificial Sequence
  Description of Artificial Sequence: Synthetic oligonucleotide
gcccuccugacgcacggcc

SEQ ID NO: 330 - RNA, 19 nt, Artificial Sequence
  Description of Artificial Sequence: Synthetic oligonucleotide
ggccgugcgucaggagggc

SEQ ID NO: 331 - RNA, 19 nt, Artificial Sequence
  Description of Artificial Sequence: Synthetic oligonucleotide
ccuccugacgcacggccaa

SEQ ID NO: 332 - RNA, 19 nt, Artificial Sequence
  Description of Artificial Sequence: Synthetic oligonucleotide
uuggccgugcgucaggagg

SEQ ID NO: 333 - RNA, 19 nt, Artificial Sequence
  Description of Artificial Sequence: Synthetic oligonucleotide
cuccugacgcacggccaag

SEQ ID NO: 334 - RNA, 19 nt, Artificial Sequence
  Description of Artificial Sequence: Synthetic oligonucleotide
cuuggccgugcgucaggag

SEQ ID NO: 335 - RNA, 19 nt, Artificial Sequence
  Description of Artificial Sequence: Synthetic oligonucleotide
uccugacgcacggccaaga

SEQ ID NO: 336 - RNA, 19 nt, Artificial Sequence
  Description of Artificial Sequence: Synthetic oligonucleotide
ucuuggccgugcgucagga

SEQ ID NO: 337 - RNA, 19 nt, Artificial Sequence
  Description of Artificial Sequence: Synthetic oligonucleotide
ccugacgcacggccaagag

SEQ ID NO: 338 - RNA, 19 nt, Artificial Sequence
  Description of Artificial Sequence: Synthetic oligonucleotide
cucuuggccgugcgucagg

SEQ ID NO: 339 - RNA, 19 nt, Artificial Sequence
  Description of Artificial Sequence: Synthetic oligonucleotide
acgcacggccaagaggaag

SEQ ID NO: 340 - RNA, 19 nt, Artificial Sequence
  Description of Artificial Sequence: Synthetic oligonucleotide
cuuccucuuggccgugcgu

SEQ ID NO: 341 - RNA, 19 nt, Artificial Sequence
  Description of Artificial Sequence: Synthetic oligonucleotide
gaggaaggccaagucgagg

SEQ ID NO: 342 - RNA, 19 nt, Artificial Sequence
  Description of Artificial Sequence: Synthetic oligonucleotide
ccucgacuuggccuuccuc

SEQ ID NO: 343 - RNA, 19 nt, Artificial Sequence
  Description of Artificial Sequence: Synthetic oligonucleotide
aggaaggccaagucgaggg

SEQ ID NO: 344 - RNA, 19 nt, Artificial Sequence
  Description of Artificial Sequence: Synthetic oligonucleotide
cccucgacuuggccuuccu

SEQ ID NO: 345 - RNA, 19 nt, Artificial Sequence
  Description of Artificial Sequence: Synthetic oligonucleotide
ggaaggccaagucgagggc

SEQ ID NO: 346 - RNA, 19 nt, Artificial Sequence
  Description of Artificial Sequence: Synthetic oligonucleotide
gcccucgacuuggccuucc

SEQ ID NO: 347 - RNA, 19 nt, Artificial Sequence
  Description of Artificial Sequence: Synthetic oligonucleotide
gaaggccaagucgagggcc

SEQ ID NO: 348 - RNA, 19 nt, Artificial Sequence
  Description of Artificial Sequence: Synthetic oligonucleotide
ggcccucgacuuggccuuc

SEQ ID NO: 349 - RNA, 19 nt, Artificial Sequence
  Description of Artificial Sequence: Synthetic oligonucleotide
caagucgagggccaagacg

SEQ ID NO: 350 - RNA, 19 nt, Artificial Sequence
  Description of Artificial Sequence: Synthetic oligonucleotide
cgucuuggcccucgacuug

SEQ ID NO: 351 - RNA, 19 nt, Artificial Sequence
  Description of Artificial Sequence: Synthetic oligonucleotide
aagucgagggccaagacga

SEQ ID NO: 352 - RNA, 19 nt, Artificial Sequence
  Description of Artificial Sequence: Synthetic oligonucleotide
ucgucuuggcccucgacuu

SEQ ID NO: 353 - RNA, 19 nt, Artificial Sequence
  Description of Artificial Sequence: Synthetic oligonucleotide
agucgagggccaagacgaa

SEQ ID NO: 354 - RNA, 19 nt, Artificial Sequence
  Description of Artificial Sequence: Synthetic oligonucleotide
uucgucuuggcccucgacu

SEQ ID NO: 355 - RNA, 19 nt, Artificial Sequence
  Description of Artificial Sequence: Synthetic oligonucleotide
gucgagggccaagacgaag

SEQ ID NO: 356 - RNA, 19 nt, Artificial Sequence
  Description of Artificial Sequence: Synthetic oligonucleotide
cuucgucuuggcccucgac

SEQ ID NO: 357 - RNA, 19 nt, Artificial Sequence
  Description of Artificial Sequence: Synthetic oligonucleotide
ucgagggccaagacgaaga

SEQ ID NO: 358 - RNA, 19 nt, Artificial Sequence
  Description of Artificial Sequence: Synthetic oligonucleotide
ucuucgucuuggcccucga

SEQ ID NO: 359 - RNA, 19 nt, Artificial Sequence
  Description of Artificial Sequence: Synthetic oligonucleotide
gagggccaagacgaagaca

SEQ ID NO: 360 - RNA, 19 nt, Artificial Sequence
  Description of Artificial Sequence: Synthetic oligonucleotide
ugucuucgucuuggcccuc

SEQ ID NO: 361 - RNA, 19 nt, Artificial Sequence
  Description of Artificial Sequence: Synthetic oligonucleotide
agggccaagacgaagacau

SEQ ID NO: 362 - RNA, 19 nt, Artificial Sequence
  Description of Artificial Sequence: Synthetic oligonucleotide
augucuucgucuuggcccu

SEQ ID NO: 363 - RNA, 19 nt, Artificial Sequence
  Description of Artificial Sequence: Synthetic oligonucleotide
ggccaagacgaagacaucc

SEQ ID NO: 364 - RNA, 19 nt, Artificial Sequence
  Description of Artificial Sequence: Synthetic oligonucleotide
ggaugucuucgucuuggcc

SEQ ID NO: 365 - RNA, 19 nt, Artificial Sequence
  Description of Artificial Sequence: Synthetic oligonucleotide
gccaagacgaagacauccc

SEQ ID NO: 366 - RNA, 19 nt, Artificial Sequence
  Description of Artificial Sequence: Synthetic oligonucleotide
gggaugucuucgucuuggc

SEQ ID NO: 367 - RNA, 19 nt, Artificial Sequence
  Description of Artificial Sequence: Synthetic oligonucleotide
agacaucccaccaaucacc

SEQ ID NO: 368 - RNA, 19 nt, Artificial Sequence
  Description of Artificial Sequence: Synthetic oligonucleotide
ggugauuggugggaugucu

SEQ ID NO: 369 - RNA, 19 nt, Artificial Sequence
  Description of Artificial Sequence: Synthetic oligonucleotide
ucccaccaaucaccugcgu

SEQ ID NO: 370 - RNA, 19 nt, Artificial Sequence
  Description of Artificial Sequence: Synthetic oligonucleotide
acgcaggugauugguggga

SEQ ID NO: 371 - RNA, 19 nt, Artificial Sequence
  Description of Artificial Sequence: Synthetic oligonucleotide
cccaccaaucaccugcgua

SEQ ID NO: 372 - RNA, 19 nt, Artificial Sequence
  Description of Artificial Sequence: Synthetic oligonucleotide
uacgcaggugauugguggg

SEQ ID NO: 373 - RNA, 19 nt, Artificial Sequence
  Description of Artificial Sequence: Synthetic oligonucleotide
ccaccaaucaccugcguac

SEQ ID NO: 374 - RNA, 19 nt, Artificial Sequence
  Description of Artificial Sequence: Synthetic oligonucleotide
guacgcaggugauuggugg

SEQ ID NO: 375 - RNA, 19 nt, Artificial Sequence
  Description of Artificial Sequence: Synthetic oligonucleotide
caccaaucaccugcguaca

SEQ ID NO: 376 - RNA, 19 nt, Artificial Sequence
  Description of Artificial Sequence: Synthetic oligonucleotide
uguacgcaggugauuggug

SEQ ID NO: 377 - RNA, 19 nt, Artificial Sequence
  Description of Artificial Sequence: Synthetic oligonucleotide
accaaucaccugcguacag

SEQ ID NO: 378 - RNA, 19 nt, Artificial Sequence
  Description of Artificial Sequence: Synthetic oligonucleotide
cuguacgcaggugauuggu

SEQ ID NO: 379 - RNA, 19 nt, Artificial Sequence
  Description of Artificial Sequence: Synthetic oligonucleotide
ccaaucaccugcguacaga

SEQ ID NO: 380 - RNA, 19 nt, Artificial Sequence
  Description of Artificial Sequence: Synthetic oligonucleotide
ucuguacgcaggugauugg

SEQ ID NO: 381 - RNA, 19 nt, Artificial Sequence
  Description of Artificial Sequence: Synthetic oligonucleotide
caaucaccugcguacagaa

SEQ ID NO: 382 - RNA, 19 nt, Artificial Sequence
  Description of Artificial Sequence: Synthetic oligonucleotide
uucuguacgcaggugauug

SEQ ID NO: 383 - RNA, 19 nt, Artificial Sequence
  Description of Artificial Sequence: Synthetic oligonucleotide
aaucaccugcguacagaac

SEQ ID NO: 384 - RNA, 19 nt, Artificial Sequence
  Description of Artificial Sequence: Synthetic oligonucleotide
guucuguacgcaggugauu

SEQ ID NO: 385 - RNA, 19 nt, Artificial Sequence
  Description of Artificial Sequence: Synthetic oligonucleotide
aucaccugcguacagaacg

SEQ ID NO: 386 - RNA, 19 nt, Artificial Sequence
  Description of Artificial Sequence: Synthetic oligonucleotide
cguucuguacgcaggugau

SEQ ID NO: 387 - RNA, 19 nt, Artificial Sequence
  Description of Artificial Sequence: Synthetic oligonucleotide
ucaccugcguacagaacgg

SEQ ID NO: 388 - RNA, 19 nt, Artificial Sequence
  Description of Artificial Sequence: Synthetic oligonucleotide
ccguucuguacgcagguga

SEQ ID NO: 389 - RNA, 19 nt, Artificial Sequence
  Description of Artificial Sequence: Synthetic oligonucleotide
caccugcguacagaacggc

SEQ ID NO: 390 - RNA, 19 nt, Artificial Sequence
  Description of Artificial Sequence: Synthetic oligonucleotide
gccguucuguacgcaggug

SEQ ID NO: 391 - RNA, 19 nt, Artificial Sequence
  Description of Artificial Sequence: Synthetic oligonucleotide
accugcguacagaacggcc

SEQ ID NO: 392 - RNA, 19 nt, Artificial Sequence
  Description of Artificial Sequence: Synthetic oligonucleotide
ggccguucuguacgcaggu

SEQ ID NO: 393 - RNA, 19 nt, Artificial Sequence
  Description of Artificial Sequence: Synthetic oligonucleotide
ccugcguacagaacggccu

SEQ ID NO: 394 - RNA, 19 nt, Artificial Sequence
  Description of Artificial Sequence: Synthetic oligonucleotide
aggccguucuguacgcagg

SEQ ID NO: 395 - RNA, 19 nt, Artificial Sequence
  Description of Artificial Sequence: Synthetic oligonucleotide
gcguacagaacggccucag

SEQ ID NO: 396 - RNA, 19 nt, Artificial Sequence
  Description of Artificial Sequence: Synthetic oligonucleotide
cugaggccguucuguacgc

SEQ ID NO: 397 - RNA, 19 nt, Artificial Sequence
  Description of Artificial Sequence: Synthetic oligonucleotide
cguacagaacggccucagg

SEQ ID NO: 398 - RNA, 19 nt, Artificial Sequence
  Description of Artificial Sequence: Synthetic oligonucleotide
ccugaggccguucuguacg

SEQ ID NO: 399 - RNA, 19 nt, Artificial Sequence
  Description of Artificial Sequence: Synthetic oligonucleotide
uacagaacggccucaggua

SEQ ID NO: 400 - RNA, 19 nt, Artificial Sequence
  Description of Artificial Sequence: Synthetic oligonucleotide
uaccugaggccguucugua

SEQ ID NO: 401 - RNA, 19 nt, Artificial Sequence
  Description of Artificial Sequence: Synthetic oligonucleotide
acagaacggccucagguac

SEQ ID NO: 402 - RNA, 19 nt, Artificial Sequence
  Description of Artificial Sequence: Synthetic oligonucleotide
guaccugaggccguucugu

SEQ ID NO: 403 - RNA, 19 nt, Artificial Sequence
  Description of Artificial Sequence: Synthetic oligonucleotide
cagaacggccucagguacc

SEQ ID NO: 404 - RNA, 19 nt, Artificial Sequence
  Description of Artificial Sequence: Synthetic oligonucleotide
gguaccugaggccguucug

SEQ ID NO: 405 - RNA, 19 nt, Artificial Sequence
  Description of Artificial Sequence: Synthetic oligonucleotide
cggccucagguaccaugac

SEQ ID NO: 406 - RNA, 19 nt, Artificial Sequence
  Description of Artificial Sequence: Synthetic oligonucleotide
gucaugguaccugaggccg

SEQ ID NO: 407 - RNA, 19 nt, Artificial Sequence
  Description of Artificial Sequence: Synthetic oligonucleotide
gccucagguaccaugaccg

SEQ ID NO: 408 - RNA, 19 nt, Artificial Sequence
  Description of Artificial Sequence: Synthetic oligonucleotide
cggucaugguaccugaggc

SEQ ID NO: 409 - RNA, 19 nt, Artificial Sequence
  Description of Artificial Sequence: Synthetic oligonucleotide
cucagguaccaugaccgag

SEQ ID NO: 410 - RNA, 19 nt, Artificial Sequence
  Description of Artificial Sequence: Synthetic oligonucleotide
cucggucaugguaccugag

SEQ ID NO: 411 - RNA, 19 nt, Artificial Sequence
  Description of Artificial Sequence: Synthetic oligonucleotide
ucagguaccaugaccgaga

SEQ ID NO: 412 - RNA, 19 nt, Artificial Sequence
  Description of Artificial Sequence: Synthetic oligonucleotide
ucucggucaugguaccuga

SEQ ID NO: 413 - RNA, 19 nt, Artificial Sequence
  Description of Artificial Sequence: Synthetic oligonucleotide
cagguaccaugaccgagac

SEQ ID NO: 414 - RNA, 19 nt, Artificial Sequence
  Description of Artificial Sequence: Synthetic oligonucleotide
gucucggucaugguaccug

SEQ ID NO: 415 - RNA, 19 nt, Artificial Sequence
  Description of Artificial Sequence: Synthetic oligonucleotide
agguaccaugaccgagacg

SEQ ID NO: 416 - RNA, 19 nt, Artificial Sequence
  Description of Artificial Sequence: Synthetic oligonucleotide
cgucucggucaugguaccu

SEQ ID NO: 417 - RNA, 19 nt, Artificial Sequence
  Description of Artificial Sequence: Synthetic oligonucleotide
gguaccaugaccgagacgu

SEQ ID NO: 418 - RNA, 19 nt, Artificial Sequence
  Description of Artificial Sequence: Synthetic oligonucleotide
acgucucggucaugguacc

SEQ ID NO: 419 - RNA, 19 nt, Artificial Sequence
  Description of Artificial Sequence: Synthetic oligonucleotide
guaccaugaccgagacgug

SEQ ID NO: 420 - RNA, 19 nt, Artificial Sequence
  Description of Artificial Sequence: Synthetic oligonucleotide
cacgucucggucaugguac

SEQ ID NO: 421 - RNA, 19 nt, Artificial Sequence
  Description of Artificial Sequence: Synthetic oligonucleotide
uaccaugaccgagacgugu

SEQ ID NO: 422 - RNA, 19 nt, Artificial Sequence
  Description of Artificial Sequence: Synthetic oligonucleotide
acacgucucggucauggua

SEQ ID NO: 423 - RNA, 19 nt, Artificial Sequence
  Description of Artificial Sequence: Synthetic oligonucleotide
ccgagacguguggaaaccc

SEQ ID NO: 424 - RNA, 19 nt, Artificial Sequence
  Description of Artificial Sequence: Synthetic oligonucleotide
ggguuuccacacgucucgg

SEQ ID NO: 425 - RNA, 19 nt, Artificial Sequence
  Description of Artificial Sequence: Synthetic oligonucleotide
cgagacguguggaaacccg

SEQ ID NO: 426 - RNA, 19 nt, Artificial Sequence
  Description of Artificial Sequence: Synthetic oligonucleotide
cggguuuccacacgucucg

SEQ ID NO: 427 - RNA, 19 nt, Artificial Sequence
  Description of Artificial Sequence: Synthetic oligonucleotide
gagacguguggaaacccga

SEQ ID NO: 428 - RNA, 19 nt, Artificial Sequence
  Description of Artificial Sequence: Synthetic oligonucleotide
ucggguuuccacacgucuc

SEQ ID NO: 429 - RNA, 19 nt, Artificial Sequence
  Description of Artificial Sequence: Synthetic oligonucleotide
agacguguggaaacccgag

SEQ ID NO: 430 - RNA, 19 nt, Artificial Sequence
  Description of Artificial Sequence: Synthetic oligonucleotide
cucggguuuccacacgucu

SEQ ID NO: 431 - RNA, 19 nt, Artificial Sequence
  Description of Artificial Sequence: Synthetic oligonucleotide
gacguguggaaacccgagc

SEQ ID NO: 432 - RNA, 19 nt, Artificial Sequence
  Description of Artificial Sequence: Synthetic oligonucleotide
gcucggguuuccacacguc

SEQ ID NO: 433 - RNA, 19 nt, Artificial Sequence
  Description of Artificial Sequence: Synthetic oligonucleotide
acguguggaaacccgagcc

SEQ ID NO: 434 - RNA, 19 nt, Artificial Sequence
  Description of Artificial Sequence: Synthetic oligonucleotide
ggcucggguuuccacacgu

SEQ ID NO: 435 - RNA, 19 nt, Artificial Sequence
  Description of Artificial Sequence: Synthetic oligonucleotide
cguguggaaacccgagccc

SEQ ID NO: 436 - RNA, 19 nt, Artificial Sequence
  Description of Artificial Sequence: Synthetic oligonucleotide
gggcucggguuuccacacg

SEQ ID NO: 437 - RNA, 19 nt, Artificial Sequence
  Description of Artificial Sequence: Synthetic oligonucleotide
guguggaaacccgagcccu

SEQ ID NO: 438 - RNA, 19 nt, Artificial Sequence
  Description of Artificial Sequence: Synthetic oligonucleotide
agggcucggguuuccacac

SEQ ID NO: 439 - RNA, 19 nt, Artificial Sequence
  Description of Artificial Sequence: Synthetic oligonucleotide
uguggaaacccgagcccug

SEQ ID NO: 440 - RNA, 19 nt, Artificial Sequence
  Description of Artificial Sequence: Synthetic oligonucleotide
cagggcucggguuuccaca

SEQ ID NO: 441 - RNA, 19 nt, Artificial Sequence
  Description of Artificial Sequence: Synthetic oligonucleotide
agcccugccggaucugcgu

SEQ ID NO: 442 - RNA, 19 nt, Artificial Sequence
  Description of Artificial Sequence: Synthetic oligonucleotide
acgcagauccggcagggcu

SEQ ID NO: 443 - RNA, 19 nt, Artificial Sequence
  Description of Artificial Sequence: Synthetic oligonucleotide
gcccugccggaucugcguc

SEQ ID NO: 444 - RNA, 19 nt, Artificial Sequence
  Description of Artificial Sequence: Synthetic oligonucleotide
gacgcagauccggcagggc

SEQ ID NO: 445 - RNA, 19 nt, Artificial Sequence
  Description of Artificial Sequence: Synthetic oligonucleotide
cccugccggaucugcgucu

SEQ ID NO: 446 - RNA, 19 nt, Artificial Sequence
  Description of Artificial Sequence: Synthetic oligonucleotide
agacgcagauccggcaggg

SEQ ID NO: 447 - RNA, 19 nt, Artificial Sequence
  Description of Artificial Sequence: Synthetic oligonucleotide
ugccggaucugcgucugcg

SEQ ID NO: 448 - RNA, 19 nt, Artificial Sequence
  Description of Artificial Sequence: Synthetic oligonucleotide
cgcagacgcagauccggca

SEQ ID NO: 449 - RNA, 19 nt, Artificial Sequence
  Description of Artificial Sequence: Synthetic oligonucleotide
ggaucugcgucugcgacaa

SEQ ID NO: 450 - RNA, 19 nt, Artificial Sequence
  Description of Artificial Sequence: Synthetic oligonucleotide
uugucgcagacgcagaucc

SEQ ID NO: 451 - RNA, 19 nt, Artificial Sequence
  Description of Artificial Sequence: Synthetic oligonucleotide
gaucugcgucugcgacaac

SEQ ID NO: 452 - RNA, 19 nt, Artificial Sequence
  Description of Artificial Sequence: Synthetic oligonucleotide
guugucgcagacgcagauc

SEQ ID NO: 453 - RNA, 19 nt, Artificial Sequence
  Description of Artificial Sequence: Synthetic oligonucleotide
aucugcgucugcgacaacg

SEQ ID NO: 454 - RNA, 19 nt, Artificial Sequence
  Description of Artificial Sequence: Synthetic oligonucleotide
cguugucgcagacgcagau

SEQ ID NO: 455 - RNA, 19 nt, Artificial Sequence
  Description of Artificial Sequence: Synthetic oligonucleotide
ucugcgucugcgacaacgg

SEQ ID NO: 456 - RNA, 19 nt, Artificial Sequence
  Description of Artificial Sequence: Synthetic oligonucleotide
ccguugucgcagacgcaga

SEQ ID NO: 457 - RNA, 19 nt, Artificial Sequence
  Description of Artificial Sequence: Synthetic oligonucleotide
cugcgucugcgacaacggc

SEQ ID NO: 458 - RNA, 19 nt, Artificial Sequence
  Description of Artificial Sequence: Synthetic oligonucleotide
gccguugucgcagacgcag

SEQ ID NO: 459 - RNA, 19 nt, Artificial Sequence
  Description of Artificial Sequence: Synthetic oligonucleotide
gcgucugcgacaacggcaa

SEQ ID NO: 460 - RNA, 19 nt, Artificial Sequence
  Description of Artificial Sequence: Synthetic oligonucleotide
uugccguugucgcagacgc

SEQ ID NO: 461 - RNA, 19 nt, Artificial Sequence
  Description of Artificial Sequence: Synthetic oligonucleotide
cgucugcgacaacggcaag

SEQ ID NO: 462 - RNA, 19 nt, Artificial Sequence
  Description of Artificial Sequence: Synthetic oligonucleotide
cuugccguugucgcagacg

SEQ ID NO: 463 - RNA, 19 nt, Artificial Sequence
  Description of Artificial Sequence: Synthetic oligonucleotide
gucugcgacaacggcaagg

SEQ ID NO: 464 - RNA, 19 nt, Artificial Sequence
  Description of Artificial Sequence: Synthetic oligonucleotide
ccuugccguugucgcagac

SEQ ID NO: 465 - RNA, 19 nt, Artificial Sequence
  Description of Artificial Sequence: Synthetic oligonucleotide
gcgacaacggcaagguguu

SEQ ID NO: 466 - RNA, 19 nt, Artificial Sequence
  Description of Artificial Sequence: Synthetic oligonucleotide
aacaccuugccguugucgc

SEQ ID NO: 467 - RNA, 19 nt, Artificial Sequence
  Description of Artificial Sequence: Synthetic oligonucleotide
cgacaacggcaagguguug

SEQ ID NO: 468 - RNA, 19 nt, Artificial Sequence
  Description of Artificial Sequence: Synthetic oligonucleotide
caacaccuugccguugucg

SEQ ID NO: 469 - RNA, 19 nt, Artificial Sequence
  Description of Artificial Sequence: Synthetic oligonucleotide
acaacggcaagguguugug

SEQ ID NO: 470 - RNA, 19 nt, Artificial Sequence
  Description of Artificial Sequence: Synthetic oligonucleotide
cacaacaccuugccguugu

SEQ ID NO: 471 - RNA, 19 nt, Artificial Sequence
  Description of Artificial Sequence: Synthetic oligonucleotide
caacggcaagguguugugc

SEQ ID NO: 472 - RNA, 19 nt, Artificial Sequence
  Description of Artificial Sequence: Synthetic oligonucleotide
gcacaacaccuugccguug

SEQ ID NO: 473 - RNA, 19 nt, Artificial Sequence
  Description of Artificial Sequence: Synthetic oligonucleotide
aacggcaagguguugugcg

SEQ ID NO: 474 - RNA, 19 nt, Artificial Sequence
  Description of Artificial Sequence: Synthetic oligonucleotide
cgcacaacaccuugccguu

SEQ ID NO: 475 - RNA, 19 nt, Artificial Sequence
  Description of Artificial Sequence: Synthetic oligonucleotide
acggcaagguguugugcga

SEQ ID NO: 476 - RNA, 19 nt, Artificial Sequence
  Description of Artificial Sequence: Synthetic oligonucleotide
ucgcacaacaccuugccgu

SEQ ID NO: 477 - RNA, 19 nt, Artificial Sequence
  Description of Artificial Sequence: Synthetic oligonucleotide
cggcaagguguugugcgau

SEQ ID NO: 478 - RNA, 19 nt, Artificial Sequence
  Description of Artificial Sequence: Synthetic oligonucleotide
aucgcacaacaccuugccg

SEQ ID NO: 479 - RNA, 19 nt, Artificial Sequence
  Description of Artificial Sequence: Synthetic oligonucleotide
ggcaagguguugugcgaug

SEQ ID NO: 480 - RNA, 19 nt, Artificial Sequence
  Description of Artificial Sequence: Synthetic oligonucleotide
caucgcacaacaccuugcc

SEQ ID NO: 481 - RNA, 19 nt, Artificial Sequence
  Description of Artificial Sequence: Synthetic oligonucleotide
gcaagguguugugcgauga

SEQ ID NO: 482 - RNA, 19 nt, Artificial Sequence
  Description of Artificial Sequence: Synthetic oligonucleotide
ucaucgcacaacaccuugc

SEQ ID NO: 483 - RNA, 19 nt, Artificial Sequence
  Description of Artificial Sequence: Synthetic oligonucleotide
caagguguugugcgaugac

SEQ ID NO: 484 - RNA, 19 nt, Artificial Sequence
  Description of Artificial Sequence: Synthetic oligonucleotide
gucaucgcacaacaccuug

SEQ ID NO: 485 - RNA, 19 nt, Artificial Sequence
  Description of Artificial Sequence: Synthetic oligonucleotide
aagguguugugcgaugacg

SEQ ID NO: 486 - RNA, 19 nt, Artificial Sequence
  Description of Artificial Sequence: Synthetic oligonucleotide
cgucaucgcacaacaccuu

SEQ ID NO: 487 - RNA, 19 nt, Artificial Sequence
  Description of Artificial Sequence: Synthetic oligonucleotide
agguguugugcgaugacgu

SEQ ID NO: 488 - RNA, 19 nt, Artificial Sequence
  Description of Artificial Sequence: Synthetic oligonucleotide
acgucaucgcacaacaccu

SEQ ID NO: 489 - RNA, 19 nt, Artificial Sequence
  Description of Artificial Sequence: Synthetic oligonucleotide
uguugugcgaugacgugau

SEQ ID NO: 490 - RNA, 19 nt, Artificial Sequence
  Description of Artificial Sequence: Synthetic oligonucleotide
aucacgucaucgcacaaca

SEQ ID NO: 491 - RNA, 19 nt, Artificial Sequence
  Description of Artificial Sequence: Synthetic oligonucleotide
guugugcgaugacgugauc

SEQ ID NO: 492 - RNA, 19 nt, Artificial Sequence
  Description of Artificial Sequence: Synthetic oligonucleotide
gaucacgucaucgcacaac

SEQ ID NO: 493 - RNA, 19 nt, Artificial Sequence
  Description of Artificial Sequence: Synthetic oligonucleotide
uugugcgaugacgugaucu

SEQ ID NO: 494 - RNA, 19 nt, Artificial Sequence
  Description of Artificial Sequence: Synthetic oligonucleotide
agaucacgucaucgcacaa

SEQ ID NO: 495 - RNA, 19 nt, Artificial Sequence
  Description of Artificial Sequence: Synthetic oligonucleotide
gugcgaugacgugaucugu

SEQ ID NO: 496 - RNA, 19 nt, Artificial Sequence
  Description of Artificial Sequence: Synthetic oligonucleotide
acagaucacgucaucgcac

SEQ ID NO: 497 - RNA, 19 nt, Artificial Sequence
  Description of Artificial Sequence: Synthetic oligonucleotide
ugcgaugacgugaucugug

SEQ ID NO: 498 - RNA, 19 nt, Artificial Sequence
  Description of Artificial Sequence: Synthetic oligonucleotide
cacagaucacgucaucgca

SEQ ID NO: 499 - RNA, 19 nt, Artificial Sequence
  Description of Artificial Sequence: Synthetic oligonucleotide
gcgaugacgugaucuguga

SEQ ID NO: 500 - RNA, 19 nt, Artificial Sequence
  Description of Artificial Sequence: Synthetic oligonucleotide
ucacagaucacgucaucgc

SEQ ID NO: 501 - RNA, 19 nt, Artificial Sequence
  Description of Artificial Sequence: Synthetic oligonucleotide
augacgugaucugugacga

SEQ ID NO: 502 - RNA, 19 nt, Artificial Sequence
  Description of Artificial Sequence: Synthetic oligonucleotide
ucgucacagaucacgucau

SEQ ID NO: 503 - RNA, 19 nt, Artificial Sequence
  Description of Artificial Sequence: Synthetic oligonucleotide
ugacgugaucugugacgag

SEQ ID NO: 504 - RNA, 19 nt, Artificial Sequence
  Description of Artificial Sequence: Synthetic oligonucleotide
cucgucacagaucacguca

SEQ ID NO: 505 - RNA, 19 nt, Artificial Sequence
  Description of Artificial Sequence: Synthetic oligonucleotide
gacgugaucugugacgaga

SEQ ID NO: 506 - RNA, 19 nt, Artificial Sequence
  Description of Artificial Sequence: Synthetic oligonucleotide
ucucgucacagaucacguc

SEQ ID NO: 507 - RNA, 19 nt, Artificial Sequence
  Description of Artificial Sequence: Synthetic oligonucleotide
ugaucugugacgagaccaa

SEQ ID NO: 508 - RNA, 19 nt, Artificial Sequence
  Description of Artificial Sequence: Synthetic oligonucleotide
uuggucucgucacagauca

SEQ ID NO: 509 - RNA, 19 nt, Artificial Sequence
  Description of Artificial Sequence: Synthetic oligonucleotide
gaucugugacgagaccaag

SEQ ID NO: 510 - RNA, 19 nt, Artificial Sequence
  Description of Artificial Sequence: Synthetic oligonucleotide
cuuggucucgucacagauc

SEQ ID NO: 511 - RNA, 19 nt, Artificial Sequence
  Description of Artificial Sequence: Synthetic oligonucleotide
aucugugacgagaccaaga

SEQ ID NO: 512 - RNA, 19 nt, Artificial Sequence
  Description of Artificial Sequence: Synthetic oligonucleotide
ucuuggucucgucacagau

SEQ ID NO: 513 - RNA, 19 nt, Artificial Sequence
  Description of Artificial Sequence: Synthetic oligonucleotide
ugugacgagaccaagaacu

SEQ ID NO: 514 - RNA, 19 nt, Artificial Sequence
  Description of Artificial Sequence: Synthetic oligonucleotide
aguucuuggucucgucaca

SEQ ID NO: 515 - RNA, 19 nt, Artificial Sequence
  Description of Artificial Sequence: Synthetic oligonucleotide
gacgagaccaagaacugcc

SEQ ID NO: 516 - RNA, 19 nt, Artificial Sequence
  Description of Artificial Sequence: Synthetic oligonucleotide
ggcaguucuuggucucguc

SEQ ID NO: 517 - RNA, 19 nt, Artificial Sequence
  Description of Artificial Sequence: Synthetic oligonucleotide
cgagaccaagaacugcccc

SEQ ID NO: 518 - RNA, 19 nt, Artificial Sequence
  Description of Artificial Sequence: Synthetic oligonucleotide
ggggcaguucuuggucucg

SEQ ID NO: 519 - RNA, 19 nt, Artificial Sequence
  Description of Artificial Sequence: Synthetic oligonucleotide
gaccaagaacugccccggc

SEQ ID NO: 520 - RNA, 19 nt, Artificial Sequence
  Description of Artificial Sequence: Synthetic oligonucleotide
gccggggcaguucuugguc

SEQ ID NO: 521 - RNA, 19 nt, Artificial Sequence
  Description of Artificial Sequence: Synthetic oligonucleotide
caagaacugccccggcgcc

SEQ ID NO: 522 - RNA, 19 nt, Artificial Sequence
  Description of Artificial Sequence: Synthetic oligonucleotide
ggcgccggggcaguucuug

SEQ ID NO: 523 - RNA, 19 nt, Artificial Sequence
  Description of Artificial Sequence: Synthetic oligonucleotide
aagaacugccccggcgccg

SEQ ID NO: 524 - RNA, 19 nt, Artificial Sequence
  Description of Artificial Sequence: Synthetic oligonucleotide
cggcgccggggcaguucuu

SEQ ID NO: 525 - RNA, 19 nt, Artificial Sequence
  Description of Artificial Sequence: Synthetic oligonucleotide
agaacugccccggcgccga

SEQ ID NO: 526 - RNA, 19 nt, Artificial Sequence
  Description of Artificial Sequence: Synthetic oligonucleotide
ucggcgccggggcaguucu

SEQ ID NO: 527 - RNA, 19 nt, Artificial Sequence
  Description of Artificial Sequence: Synthetic oligonucleotide
cugccccggcgccgaaguc

SEQ ID NO: 528 - RNA, 19 nt, Artificial Sequence
  Description of Artificial Sequence: Synthetic oligonucleotide
gacuucggcgccggggcag

SEQ ID NO: 529 - RNA, 19 nt, Artificial Sequence
  Description of Artificial Sequence: Synthetic oligonucleotide
gccccggcgccgaaguccc

SEQ ID NO: 530 - RNA, 19 nt, Artificial Sequence
  Description of Artificial Sequence: Synthetic oligonucleotide
gggacuucggcgccggggc

SEQ ID NO: 531 - RNA, 19 nt, Artificial Sequence
  Description of Artificial Sequence: Synthetic oligonucleotide
ccccggcgccgaagucccc

SEQ ID NO: 532 - RNA, 19 nt, Artificial Sequence
  Description of Artificial Sequence: Synthetic oligonucleotide
ggggacuucggcgccgggg

SEQ ID NO: 533 - RNA, 19 nt, Artificial Sequence
  Description of Artificial Sequence: Synthetic oligonucleotide
cccggcgccgaaguccccg

SEQ ID NO: 534 - RNA, 19 nt, Artificial Sequence
  Description of Artificial Sequence: Synthetic oligonucleotide
cggggacuucggcgccggg

SEQ ID NO: 535 - RNA, 19 nt, Artificial Sequence
  Description of Artificial Sequence: Synthetic oligonucleotide
uccccgagggcgagugcug

SEQ ID NO: 536 - RNA, 19 nt, Artificial Sequence
  Description of Artificial Sequence: Synthetic oligonucleotide
cagcacucgcccucgggga

SEQ ID NO: 537 - RNA, 19 nt, Artificial Sequence
  Description of Artificial Sequence: Synthetic oligonucleotide
cccgagggcgagugcuguc

SEQ ID NO: 538 - RNA, 19 nt, Artificial Sequence
  Description of Artificial Sequence: Synthetic oligonucleotide
gacagcacucgcccucggg

SEQ ID NO: 539 - RNA, 19 nt, Artificial Sequence
  Description of Artificial Sequence: Synthetic oligonucleotide
ccgagggcgagugcugucc

SEQ ID NO: 540 - RNA, 19 nt, Artificial Sequence
  Description of Artificial Sequence: Synthetic oligonucleotide
ggacagcacucgcccucgg

SEQ ID NO: 541 - RNA, 19 nt, Artificial Sequence
  Description of Artificial Sequence: Synthetic oligonucleotide
agggcgagugcugucccgu

SEQ ID NO: 542 - RNA, 19 nt, Artificial Sequence
  Description of Artificial Sequence: Synthetic oligonucleotide
acgggacagcacucgcccu

SEQ ID NO: 543 - RNA, 19 nt, Artificial Sequence
  Description of Artificial Sequence: Synthetic oligonucleotide
gggcgagugcugucccguc

SEQ ID NO: 544 - RNA, 19 nt, Artificial Sequence
  Description of Artificial Sequence: Synthetic oligonucleotide
gacgggacagcacucgccc

SEQ ID NO: 545 - RNA, 19 nt, Artificial Sequence
  Description of Artificial Sequence: Synthetic oligonucleotide
ggcgagugcugucccgucu

SEQ ID NO: 546 - RNA, 19 nt, Artificial Sequence
  Description of Artificial Sequence: Synthetic oligonucleotide
agacgggacagcacucgcc

SEQ ID NO: 547 - RNA, 19 nt, Artificial Sequence
  Description of Artificial Sequence: Synthetic oligonucleotide
ccccgacggcucagaguca

SEQ ID NO: 548 - RNA, 19 nt, Artificial Sequence
  Description of Artificial Sequence: Synthetic oligonucleotide
ugacucugagccgucgggg

SEQ ID NO: 549 - RNA, 19 nt, Artificial Sequence
  Description of Artificial Sequence: Synthetic oligonucleotide
cccgacggcucagagucac

SEQ ID NO: 550 - RNA, 19 nt, Artificial Sequence
  Description of Artificial Sequence: Synthetic oligonucleotide
gugacucugagccgucggg

SEQ ID NO: 551 - RNA, 19 nt, Artificial Sequence
  Description of Artificial Sequence: Synthetic oligonucleotide
ccgacggcucagagucacc

SEQ ID NO: 552 - RNA, 19 nt, Artificial Sequence
  Description of Artificial Sequence: Synthetic oligonucleotide
ggugacucugagccgucgg

SEQ ID NO: 553 - RNA, 19 nt, Artificial Sequence
  Description of Artificial Sequence: Synthetic oligonucleotide
cgacggcucagagucaccc

SEQ ID NO: 554 - RNA, 19 nt, Artificial Sequence
  Description of Artificial Sequence: Synthetic oligonucleotide
gggugacucugagccgucg

SEQ ID NO: 555 - RNA, 19 nt, Artificial Sequence
  Description of Artificial Sequence: Synthetic oligonucleotide
gacggcucagagucaccca

SEQ ID NO: 556 - RNA, 19 nt, Artificial Sequence
  Description of Artificial Sequence: Synthetic oligonucleotide
ugggugacucugagccguc

SEQ ID NO: 557 - RNA, 19 nt, Artificial Sequence
  Description of Artificial Sequence: Synthetic oligonucleotide
gcucagagucacccaccga

SEQ ID NO: 558 - RNA, 19 nt, Artificial Sequence
  Description of Artificial Sequence: Synthetic oligonucleotide
ucggugggugacucugagc

SEQ ID NO: 559 - RNA, 19 nt, Artificial Sequence
  Description of Artificial Sequence: Synthetic oligonucleotide
cucagagucacccaccgac

SEQ ID NO: 560 - RNA, 19 nt, Artificial Sequence
  Description of Artificial Sequence: Synthetic oligonucleotide
gucggugggugacucugag

SEQ ID NO: 561 - RNA, 19 nt, Artificial Sequence
  Description of Artificial Sequence: Synthetic oligonucleotide
ucagagucacccaccgacc

SEQ ID NO: 562 - RNA, 19 nt, Artificial Sequence
  Description of Artificial Sequence: Synthetic oligonucleotide
ggucggugggugacucuga

SEQ ID NO: 563 - RNA, 19 nt, Artificial Sequence
  Description of Artificial Sequence: Synthetic oligonucleotide
cagagucacccaccgacca

SEQ ID NO: 564 - RNA, 19 nt, Artificial Sequence
  Description of Artificial Sequence: Synthetic oligonucleotide
uggucggugggugacucug

SEQ ID NO: 565 - RNA, 19 nt, Artificial Sequence
  Description of Artificial Sequence: Synthetic oligonucleotide
agagucacccaccgaccaa

SEQ ID NO: 566 - RNA, 19 nt, Artificial Sequence
  Description of Artificial Sequence: Synthetic oligonucleotide
uuggucggugggugacucu

SEQ ID NO: 567 - RNA, 19 nt, Artificial Sequence
  Description of Artificial Sequence: Synthetic oligonucleotide
gagucacccaccgaccaag

SEQ ID NO: 568 - RNA, 19 nt, Artificial Sequence
  Description of Artificial Sequence: Synthetic oligonucleotide
cuuggucggugggugacuc

SEQ ID NO: 569 - RNA, 19 nt, Artificial Sequence
  Description of Artificial Sequence: Synthetic oligonucleotide
agucacccaccgaccaaga

SEQ ID NO: 570 - RNA, 19 nt, Artificial Sequence
  Description of Artificial Sequence: Synthetic oligonucleotide
ucuuggucggugggugacu

SEQ ID NO: 571 - RNA, 19 nt, Artificial Sequence
  Description of Artificial Sequence: Synthetic oligonucleotide
ucacccaccgaccaagaaa

SEQ ID NO: 572 - RNA, 19 nt, Artificial Sequence
  Description of Artificial Sequence: Synthetic oligonucleotide
uuucuuggucgguggguga

SEQ ID NO: 573 - RNA, 19 nt, Artificial Sequence
  Description of Artificial Sequence: Synthetic oligonucleotide
caccgaccaagaaaccacc

SEQ ID NO: 574 - RNA, 19 nt, Artificial Sequence
  Description of Artificial Sequence: Synthetic oligonucleotide
ggugguuucuuggucggug

SEQ ID NO: 575 - RNA, 19 nt, Artificial Sequence
  Description of Artificial Sequence: Synthetic oligonucleotide
cgaccaagaaaccaccggc

SEQ ID NO: 576 - RNA, 19 nt, Artificial Sequence
  Description of Artificial Sequence: Synthetic oligonucleotide
gccggugguuucuuggucg

SEQ ID NO: 577 - RNA, 19 nt, Artificial Sequence
  Description of Artificial Sequence: Synthetic oligonucleotide
gaccaagaaaccaccggcg

SEQ ID NO: 578 - RNA, 19 nt, Artificial Sequence
  Description of Artificial Sequence: Synthetic oligonucleotide
cgccggugguuucuugguc

SEQ ID NO: 579 - RNA, 19 nt, Artificial Sequence
  Description of Artificial Sequence: Synthetic oligonucleotide
accaagaaaccaccggcgu

SEQ ID NO: 580 - RNA, 19 nt, Artificial Sequence
  Description of Artificial Sequence: Synthetic oligonucleotide
acgccggugguuucuuggu

SEQ ID NO: 581 - RNA, 19 nt, Artificial Sequence
  Description of Artificial Sequence: Synthetic oligonucleotide
ccaagaaaccaccggcguc

SEQ ID NO: 582 - RNA, 19 nt, Artificial Sequence
  Description of Artificial Sequence: Synthetic oligonucleotide
gacgccggugguuucuugg

SEQ ID NO: 583 - RNA, 19 nt, Artificial Sequence
  Description of Artificial Sequence: Synthetic oligonucleotide
caagaaaccaccggcgucg

SEQ ID NO: 584 - RNA, 19 nt, Artificial Sequence
  Description of Artificial Sequence: Synthetic oligonucleotide
cgacgccggugguuucuug

SEQ ID NO: 585 - RNA, 19 nt, Artificial Sequence
  Description of Artificial Sequence: Synthetic oligonucleotide
aagaaaccaccggcgucga

SEQ ID NO: 586 - RNA, 19 nt, Artificial Sequence
  Description of Artificial Sequence: Synthetic oligonucleotide
ucgacgccggugguuucuu

SEQ ID NO: 587 - RNA, 19 nt, Artificial Sequence
  Description of Artificial Sequence: Synthetic oligonucleotide
agaaaccaccggcgucgag

SEQ ID NO: 588 - RNA, 19 nt, Artificial Sequence
  Description of Artificial Sequence: Synthetic oligonucleotide
cucgacgccggugguuucu

SEQ ID NO: 589 - RNA, 19 nt, Artificial Sequence
  Description of Artificial Sequence: Synthetic oligonucleotide
gaaaccaccggcgucgagg

SEQ ID NO: 590 - RNA, 19 nt, Artificial Sequence
  Description of Artificial Sequence: Synthetic oligonucleotide
ccucgacgccggugguuuc

SEQ ID NO: 591 - RNA, 19 nt, Artificial Sequence
  Description of Artificial Sequence: Synthetic oligonucleotide
aaaccaccggcgucgaggg

SEQ ID NO: 592 - RNA, 19 nt, Artificial Sequence
  Description of Artificial Sequence: Synthetic oligonucleotide
cccucgacgccggugguuu

SEQ ID NO: 593 - RNA, 19 nt, Artificial Sequence
  Description of Artificial Sequence: Synthetic oligonucleotide
aaccaccggcgucgaggga

SEQ ID NO: 594 - RNA, 19 nt, Artificial Sequence
  Description of Artificial Sequence: Synthetic oligonucleotide
ucccucgacgccggugguu

SEQ ID NO: 595 - RNA, 19 nt, Artificial Sequence
  Description of Artificial Sequence: Synthetic oligonucleotide
accaccggcgucgagggac

SEQ ID NO: 596 - RNA, 19 nt, Artificial Sequence
  Description of Artificial Sequence: Synthetic oligonucleotide
gucccucgacgccgguggu

SEQ ID NO: 597 - RNA, 19 nt, Artificial Sequence
  Description of Artificial Sequence: Synthetic oligonucleotide
ccaccggcgucgagggacc

SEQ ID NO: 598 - RNA, 19 nt, Artificial Sequence
  Description of Artificial Sequence: Synthetic oligonucleotide
ggucccucgacgccggugg

SEQ ID NO: 599 - RNA, 19 nt, Artificial Sequence
  Description of Artificial Sequence: Synthetic oligonucleotide
caccggcgucgagggaccc

SEQ ID NO: 600 - RNA, 19 nt, Artificial Sequence
  Description of Artificial Sequence: Synthetic oligonucleotide
gggucccucgacgccggug

SEQ ID NO: 601 - RNA, 19 nt, Artificial Sequence
  Description of Artificial Sequence: Synthetic oligonucleotide
accggcgucgagggaccca

SEQ ID NO: 602 - RNA, 19 nt, Artificial Sequence
  Description of Artificial Sequence: Synthetic oligonucleotide
ugggucccucgacgccggu

SEQ ID NO: 603 - RNA, 19 nt, Artificial Sequence
  Description of Artificial Sequence: Synthetic oligonucleotide
cggcgucgagggacccaag

SEQ ID NO: 604 - RNA, 19 nt, Artificial Sequence
  Description of Artificial Sequence: Synthetic oligonucleotide
cuugggucccucgacgccg

SEQ ID NO: 605 - RNA, 19 nt, Artificial Sequence
  Description of Artificial Sequence: Synthetic oligonucleotide
ggcgucgagggacccaagg

SEQ ID NO: 606 - RNA, 19 nt, Artificial Sequence
  Description of Artificial Sequence: Synthetic oligonucleotide
ccuugggucccucgacgcc

SEQ ID NO: 607 - RNA, 19 nt, Artificial Sequence
  Description of Artificial Sequence: Synthetic oligonucleotide
gcgucgagggacccaaggg

SEQ ID NO: 608 - RNA, 19 nt, Artificial Sequence
  Description of Artificial Sequence: Synthetic oligonucleotide
cccuugggucccucgacgc

SEQ ID NO: 609 - RNA, 19 nt, Artificial Sequence
  Description of Artificial Sequence: Synthetic oligonucleotide
agacacuggcccccgaggc

SEQ ID NO: 610 - RNA, 19 nt, Artificial Sequence
  Description of Artificial Sequence: Synthetic oligonucleotide
gccucgggggccagugucu

SEQ ID NO: 611 - RNA, 19 nt, Artificial Sequence
  Description of Artificial Sequence: Synthetic oligonucleotide
gaggcccaaggggacccgc

SEQ ID NO: 612 - RNA, 19 nt, Artificial Sequence
  Description of Artificial Sequence: Synthetic oligonucleotide
gcggguccccuugggccuc

SEQ ID NO: 613 - RNA, 19 nt, Artificial Sequence
  Description of Artificial Sequence: Synthetic oligonucleotide
aggcccaaggggacccgca

SEQ ID NO: 614 - RNA, 19 nt, Artificial Sequence
  Description of Artificial Sequence: Synthetic oligonucleotide
ugcggguccccuugggccu

SEQ ID NO: 615 - RNA, 19 nt, Artificial Sequence
  Description of Artificial Sequence: Synthetic oligonucleotide
ggcccaaggggacccgcag

SEQ ID NO: 616 - RNA, 19 nt, Artificial Sequence
  Description of Artificial Sequence: Synthetic oligonucleotide
cugcggguccccuugggcc

SEQ ID NO: 617 - RNA, 19 nt, Artificial Sequence
  Description of Artificial Sequence: Synthetic oligonucleotide
ccuggccucggaggaaacu

SEQ ID NO: 618 - RNA, 19 nt, Artificial Sequence
  Description of Artificial Sequence: Synthetic oligonucleotide
aguuuccuccgaggccagg

SEQ ID NO: 619 - RNA, 19 nt, Artificial Sequence
  Description of Artificial Sequence: Synthetic oligonucleotide
ucggaggaaacuuugcucc

SEQ ID NO: 620 - RNA, 19 nt, Artificial Sequence
  Description of Artificial Sequence: Synthetic oligonucleotide
ggagcaaaguuuccuccga

SEQ ID NO: 621 - RNA, 19 nt, Artificial Sequence
  Description of Artificial Sequence: Synthetic oligonucleotide
cggaggaaacuuugcuccc

SEQ ID NO: 622 - RNA, 19 nt, Artificial Sequence
  Description of Artificial Sequence: Synthetic oligonucleotide
gggagcaaaguuuccuccg

SEQ ID NO: 623 - RNA, 19 nt, Artificial Sequence
  Description of Artificial Sequence: Synthetic oligonucleotide
ggaaacuuugcuccccagc

SEQ ID NO: 624 - RNA, 19 nt, Artificial Sequence
  Description of Artificial Sequence: Synthetic oligonucleotide
gcuggggagcaaaguuucc

SEQ ID NO: 625 - RNA, 19 nt, Artificial Sequence
  Description of Artificial Sequence: Synthetic oligonucleotide
gaaacuuugcuccccagcu

SEQ ID NO: 626 - RNA, 19 nt, Artificial Sequence
  Description of Artificial Sequence: Synthetic oligonucleotide
agcuggggagcaaaguuuc

SEQ ID NO: 627 - RNA, 19 nt, Artificial Sequence
  Description of Artificial Sequence: Synthetic oligonucleotide
aaacuuugcuccccagcug

SEQ ID NO: 628 - RNA, 19 nt, Artificial Sequence
  Description of Artificial Sequence: Synthetic oligonucleotide
cagcuggggagcaaaguuu

SEQ ID NO: 629 - RNA, 19 nt, Artificial Sequence
  Description of Artificial Sequence: Synthetic oligonucleotide
ugcuccccagcugucuuau

SEQ ID NO: 630 - RNA, 19 nt, Artificial Sequence
  Description of Artificial Sequence: Synthetic oligonucleotide
auaagacagcuggggagca

SEQ ID NO: 631 - RNA, 19 nt, Artificial Sequence
  Description of Artificial Sequence: Synthetic oligonucleotide
gcuccccagcugucuuaug

SEQ ID NO: 632 - RNA, 19 nt, Artificial Sequence
  Description of Artificial Sequence: Synthetic oligonucleotide
cauaagacagcuggggagc

SEQ ID NO: 633 - RNA, 19 nt, Artificial Sequence
  Description of Artificial Sequence: Synthetic oligonucleotide
ccccagcugucuuauggcu

SEQ ID NO: 634 - RNA, 19 nt, Artificial Sequence
  Description of Artificial Sequence: Synthetic oligonucleotide
agccauaagacagcugggg

SEQ ID NO: 635 - RNA, 19 nt, Artificial Sequence
  Description of Artificial Sequence: Synthetic oligonucleotide
cccagcugucuuauggcua

SEQ ID NO: 636 - RNA, 19 nt, Artificial Sequence
  Description of Artificial Sequence: Synthetic oligonucleotide
uagccauaagacagcuggg

SEQ ID NO: 637 - RNA, 19 nt, Artificial Sequence
  Description of Artificial Sequence: Synthetic oligonucleotide
ccagcugucuuauggcuau

SEQ ID NO: 638 - RNA, 19 nt, Artificial Sequence
  Description of Artificial Sequence: Synthetic oligonucleotide
auagccauaagacagcugg

SEQ ID NO: 639 - RNA, 19 nt, Artificial Sequence
  Description of Artificial Sequence: Synthetic oligonucleotide
cugucuuauggcuaugaug

SEQ ID NO: 640 - RNA, 19 nt, Artificial Sequence
  Description of Artificial Sequence: Synthetic oligonucleotide
caucauagccauaagacag

SEQ ID NO: 641 - RNA, 19 nt, Artificial Sequence
  Description of Artificial Sequence: Synthetic oligonucleotide
ucuuauggcuaugaugaga

SEQ ID NO: 642 - RNA, 19 nt, Artificial Sequence
  Description of Artificial Sequence: Synthetic oligonucleotide
ucucaucauagccauaaga

SEQ ID NO: 643 - RNA, 19 nt, Artificial Sequence
  Description of Artificial Sequence: Synthetic oligonucleotide
cuuauggcuaugaugagaa

SEQ ID NO: 644 - RNA, 19 nt, Artificial Sequence
  Description of Artificial Sequence: Synthetic oligonucleotide
uucucaucauagccauaag

SEQ ID NO: 645 - RNA, 19 nt, Artificial Sequence
  Description of Artificial Sequence: Synthetic oligonucleotide
uuauggcuaugaugagaaa

SEQ ID NO: 646 - RNA, 19 nt, Artificial Sequence
  Description of Artificial Sequence: Synthetic oligonucleotide
uuucucaucauagccauaa

SEQ ID NO: 647 - RNA, 19 nt, Artificial Sequence
  Description of Artificial Sequence: Synthetic oligonucleotide
ugaugagaaaucaaccgga

SEQ ID NO: 648 - RNA, 19 nt, Artificial Sequence
  Description of Artificial Sequence: Synthetic oligonucleotide
uccgguugauuucucauca

SEQ ID NO: 649 - RNA, 19 nt, Artificial Sequence
  Description of Artificial Sequence: Synthetic oligonucleotide
gaugagaaaucaaccggag

SEQ ID NO: 650 - RNA, 19 nt, Artificial Sequence
  Description of Artificial Sequence: Synthetic oligonucleotide
cuccgguugauuucucauc

SEQ ID NO: 651 - RNA, 19 nt, Artificial Sequence
  Description of Artificial Sequence: Synthetic oligonucleotide
gagaaaucaaccggaggaa

SEQ ID NO: 652 - RNA, 19 nt, Artificial Sequence
  Description of Artificial Sequence: Synthetic oligonucleotide
uuccuccgguugauuucuc

SEQ ID NO: 653 - RNA, 19 nt, Artificial Sequence
  Description of Artificial Sequence: Synthetic oligonucleotide
agaaaucaaccggaggaau

SEQ ID NO: 654 - RNA, 19 nt, Artificial Sequence
  Description of Artificial Sequence: Synthetic oligonucleotide
auuccuccgguugauuucu

SEQ ID NO: 655 - RNA, 19 nt, Artificial Sequence
  Description of Artificial Sequence: Synthetic oligonucleotide
gaaaucaaccggaggaauu

SEQ ID NO: 656 - RNA, 19 nt, Artificial Sequence
  Description of Artificial Sequence: Synthetic oligonucleotide
aauuccuccgguugauuuc

SEQ ID NO: 657 - RNA, 19 nt, Artificial Sequence
  Description of Artificial Sequence: Synthetic oligonucleotide
aaaucaaccggaggaauuu

SEQ ID NO: 658 - RNA, 19 nt, Artificial Sequence
  Description of Artificial Sequence: Synthetic oligonucleotide
aaauuccuccgguugauuu

SEQ ID NO: 659 - RNA, 19 nt, Artificial Sequence
  Description of Artificial Sequence: Synthetic oligonucleotide
caaccggaggaauuuccgu

SEQ ID NO: 660 - RNA, 19 nt, Artificial Sequence
  Description of Artificial Sequence: Synthetic oligonucleotide
acggaaauuccuccgguug

SEQ ID NO: 661 - RNA, 19 nt, Artificial Sequence
  Description of Artificial Sequence: Synthetic oligonucleotide
aaccggaggaauuuccgug

SEQ ID NO: 662 - RNA, 19 nt, Artificial Sequence
  Description of Artificial Sequence: Synthetic oligonucleotide
cacggaaauuccuccgguu

SEQ ID NO: 663 - RNA, 19 nt, Artificial Sequence
  Description of Artificial Sequence: Synthetic oligonucleotide
accggaggaauuuccgugc

SEQ ID NO: 664 - RNA, 19 nt, Artificial Sequence
  Description of Artificial Sequence: Synthetic oligonucleotide
gcacggaaauuccuccggu

SEQ ID NO: 665 - RNA, 19 nt, Artificial Sequence
  Description of Artificial Sequence: Synthetic oligonucleotide
ccggaggaauuuccgugcc

SEQ ID NO: 666 - RNA, 19 nt, Artificial Sequence
  Description of Artificial Sequence: Synthetic oligonucleotide
ggcacggaaauuccuccgg

SEQ ID NO: 667 - RNA, 19 nt, Artificial Sequence
  Description of Artificial Sequence: Synthetic oligonucleotide
gaggaauuuccgugccugg

SEQ ID NO: 668 - RNA, 19 nt, Artificial Sequence
  Description of Artificial Sequence: Synthetic oligonucleotide
ccaggcacggaaauuccuc

SEQ ID NO: 669 - RNA, 19 nt, Artificial Sequence
  Description of Artificial Sequence: Synthetic oligonucleotide
ggaauuuccgugccuggcc

SEQ ID NO: 670 - RNA, 19 nt, Artificial Sequence
  Description of Artificial Sequence: Synthetic oligonucleotide
ggccaggcacggaaauucc

SEQ ID NO: 671 - RNA, 19 nt, Artificial Sequence
  Description of Artificial Sequence: Synthetic oligonucleotide
aauuuccgugccuggcccc

SEQ ID NO: 672 - RNA, 19 nt, Artificial Sequence
  Description of Artificial Sequence: Synthetic oligonucleotide
ggggccaggcacggaaauu

SEQ ID NO: 673 - RNA, 19 nt, Artificial Sequence
  Description of Artificial Sequence: Synthetic oligonucleotide
cccucugguccucgugguc

SEQ ID NO: 674 - RNA, 19 nt, Artificial Sequence
  Description of Artificial Sequence: Synthetic oligonucleotide
gaccacgaggaccagaggg

SEQ ID NO: 675 - RNA, 19 nt, Artificial Sequence
  Description of Artificial Sequence: Synthetic oligonucleotide
cuggccccccuggugcacc

SEQ ID NO: 676 - RNA, 19 nt, Artificial Sequence
  Description of Artificial Sequence: Synthetic oligonucleotide
ggugcaccaggggggccag

SEQ ID NO: 677 - RNA, 19 nt, Artificial Sequence
  Description of Artificial Sequence: Synthetic oligonucleotide
uggccccccuggugcaccu

SEQ ID NO: 678 - RNA, 19 nt, Artificial Sequence
  Description of Artificial Sequence: Synthetic oligonucleotide
aggugcaccaggggggcca

SEQ ID NO: 679 - RNA, 19 nt, Artificial Sequence
  Description of Artificial Sequence: Synthetic oligonucleotide
cccaaggcuuccaaggucc

SEQ ID NO: 680 - RNA, 19 nt, Artificial Sequence
  Description of Artificial Sequence: Synthetic oligonucleotide
ggaccuuggaagccuuggg

SEQ ID NO: 681 - RNA, 19 nt, Artificial Sequence
  Description of Artificial Sequence: Synthetic oligonucleotide
ccaaggcuuccaagguccc

SEQ ID NO: 682 - RNA, 19 nt, Artificial Sequence
  Description of Artificial Sequence: Synthetic oligonucleotide
gggaccuuggaagccuugg

SEQ ID NO: 683 - RNA, 19 nt, Artificial Sequence
  Description of Artificial Sequence: Synthetic oligonucleotide
caaggucccccuggugagc

SEQ ID NO: 684 - RNA, 19 nt, Artificial Sequence
  Description of Artificial Sequence: Synthetic oligonucleotide
gcucaccagggggaccuug

SEQ ID NO: 685 - RNA, 19 nt, Artificial Sequence
  Description of Artificial Sequence: Synthetic oligonucleotide
ggugagccuggcgagccug

SEQ ID NO: 686 - RNA, 19 nt, Artificial Sequence
  Description of Artificial Sequence: Synthetic oligonucleotide
caggcucgccaggcucacc

SEQ ID NO: 687 - RNA, 19 nt, Artificial Sequence
  Description of Artificial Sequence: Synthetic oligonucleotide
cuggcgagccuggagcuuc

SEQ ID NO: 688 - RNA, 19 nt, Artificial Sequence
  Description of Artificial Sequence: Synthetic oligonucleotide
gaagcuccaggcucgccag

SEQ ID NO: 689 - RNA, 19 nt, Artificial Sequence
  Description of Artificial Sequence: Synthetic oligonucleotide
uggagcuucaggucccaug

SEQ ID NO: 690 - RNA, 19 nt, Artificial Sequence
  Description of Artificial Sequence: Synthetic oligonucleotide
caugggaccugaagcucca

SEQ ID NO: 691 - RNA, 19 nt, Artificial Sequence
  Description of Artificial Sequence: Synthetic oligonucleotide
ggagcuucaggucccaugg

SEQ ID NO: 692 - RNA, 19 nt, Artificial Sequence
  Description of Artificial Sequence: Synthetic oligonucleotide
ccaugggaccugaagcucc

SEQ ID NO: 693 - RNA, 19 nt, Artificial Sequence
  Description of Artificial Sequence: Synthetic oligonucleotide
gagcuucaggucccauggg

SEQ ID NO: 694 - RNA, 19 nt, Artificial Sequence
  Description of Artificial Sequence: Synthetic oligonucleotide
cccaugggaccugaagcuc

SEQ ID NO: 695 - RNA, 19 nt, Artificial Sequence
  Description of Artificial Sequence: Synthetic oligonucleotide
ggucccauggguccccgag

SEQ ID NO: 696 - RNA, 19 nt, Artificial Sequence
  Description of Artificial Sequence: Synthetic oligonucleotide
cucggggacccaugggacc

SEQ ID NO: 697 - RNA, 19 nt, Artificial Sequence
  Description of Artificial Sequence: Synthetic oligonucleotide
cauggguccccgagguccc

SEQ ID NO: 698 - RNA, 19 nt, Artificial Sequence
  Description of Artificial Sequence: Synthetic oligonucleotide
gggaccucggggacccaug

SEQ ID NO: 699 - RNA, 19 nt, Artificial Sequence
  Description of Artificial Sequence: Synthetic oligonucleotide
uggguccccgagguccccc

SEQ ID NO: 700 - RNA, 19 nt, Artificial Sequence
  Description of Artificial Sequence: Synthetic oligonucleotide
gggggaccucggggaccca

SEQ ID NO: 701 - RNA, 19 nt, Artificial Sequence
  Description of Artificial Sequence: Synthetic oligonucleotide
aaagaauggagaugauggg

SEQ ID NO: 702 - RNA, 19 nt, Artificial Sequence
  Description of Artificial Sequence: Synthetic oligonucleotide
cccaucaucuccauucuuu

SEQ ID NO: 703 - RNA, 19 nt, Artificial Sequence
  Description of Artificial Sequence: Synthetic oligonucleotide
aagaauggagaugaugggg

SEQ ID NO: 704 - RNA, 19 nt, Artificial Sequence
  Description of Artificial Sequence: Synthetic oligonucleotide
ccccaucaucuccauucuu

SEQ ID NO: 705 - RNA, 19 nt, Artificial Sequence
  Description of Artificial Sequence: Synthetic oligonucleotide
cuggaaaaccuggucgucc

SEQ ID NO: 706 - RNA, 19 nt, Artificial Sequence
  Description of Artificial Sequence: Synthetic oligonucleotide
ggacgaccagguuuuccag

SEQ ID NO: 707 - RNA, 19 nt, Artificial Sequence
  Description of Artificial Sequence: Synthetic oligonucleotide
uggaaaaccuggucguccu

SEQ ID NO: 708 - RNA, 19 nt, Artificial Sequence
  Description of Artificial Sequence: Synthetic oligonucleotide
aggacgaccagguuuucca

SEQ ID NO: 709 - RNA, 19 nt, Artificial Sequence
  Description of Artificial Sequence: Synthetic oligonucleotide
ggaaaaccuggucguccug

SEQ ID NO: 710 - RNA, 19 nt, Artificial Sequence
  Description of Artificial Sequence: Synthetic oligonucleotide
caggacgaccagguuuucc

SEQ ID NO: 711 - RNA, 19 nt, Artificial Sequence
  Description of Artificial Sequence: Synthetic oligonucleotide
gaaaaccuggucguccugg

SEQ ID NO: 712 - RNA, 19 nt, Artificial Sequence
  Description of Artificial Sequence: Synthetic oligonucleotide
ccaggacgaccagguuuuc

SEQ ID NO: 713 - RNA, 19 nt, Artificial Sequence
  Description of Artificial Sequence: Synthetic oligonucleotide
uggucguccuggugagcgu

SEQ ID NO: 714 - RNA, 19 nt, Artificial Sequence
  Description of Artificial Sequence: Synthetic oligonucleotide
acgcucaccaggacgacca

SEQ ID NO: 715 - RNA, 19 nt, Artificial Sequence
  Description of Artificial Sequence: Synthetic oligonucleotide
ucguccuggugagcguggg

SEQ ID NO: 716 - RNA, 19 nt, Artificial Sequence
  Description of Artificial Sequence: Synthetic oligonucleotide
cccacgcucaccaggacga

SEQ ID NO: 717 - RNA, 19 nt, Artificial Sequence
  Description of Artificial Sequence: Synthetic oligonucleotide
cguccuggugagcgugggc

SEQ ID NO: 718 - RNA, 19 nt, Artificial Sequence
  Description of Artificial Sequence: Synthetic oligonucleotide
gcccacgcucaccaggacg

SEQ ID NO: 719 - RNA, 19 nt, Artificial Sequence
  Description of Artificial Sequence: Synthetic oligonucleotide
gggccucagggugcucgag

SEQ ID NO: 720 - RNA, 19 nt, Artificial Sequence
  Description of Artificial Sequence: Synthetic oligonucleotide
cucgagcacccugaggccc

SEQ ID NO: 721 - RNA, 19 nt, Artificial Sequence
  Description of Artificial Sequence: Synthetic oligonucleotide
ggccucagggugcucgagg

SEQ ID NO: 722 - RNA, 19 nt, Artificial Sequence
  Description of Artificial Sequence: Synthetic oligonucleotide
ccucgagcacccugaggcc

SEQ ID NO: 723 - RNA, 19 nt, Artificial Sequence
  Description of Artificial Sequence: Synthetic oligonucleotide
cucagggugcucgaggauu

SEQ ID NO: 724 - RNA, 19 nt, Artificial Sequence
  Description of Artificial Sequence: Synthetic oligonucleotide
aauccucgagcacccugag

SEQ ID NO: 725 - RNA, 19 nt, Artificial Sequence
  Description of Artificial Sequence: Synthetic oligonucleotide
ucagggugcucgaggauug

SEQ ID NO: 726 - RNA, 19 nt, Artificial Sequence
  Description of Artificial Sequence: Synthetic oligonucleotide
caauccucgagcacccuga

SEQ ID NO: 727 - RNA, 19 nt, Artificial Sequence
  Description of Artificial Sequence: Synthetic oligonucleotide
cagggugcucgaggauugc

SEQ ID NO: 728 - RNA, 19 nt, Artificial Sequence
  Description of Artificial Sequence: Synthetic oligonucleotide
gcaauccucgagcacccug

SEQ ID NO: 729 - RNA, 19 nt, Artificial Sequence
  Description of Artificial Sequence: Synthetic oligonucleotide
agggugcucgaggauugcc

SEQ ID NO: 730 - RNA, 19 nt, Artificial Sequence
  Description of Artificial Sequence: Synthetic oligonucleotide
ggcaauccucgagcacccu

SEQ ID NO: 731 - RNA, 19 nt, Artificial Sequence
  Description of Artificial Sequence: Synthetic oligonucleotide
gggugcucgaggauugccc

SEQ ID NO: 732 - RNA, 19 nt, Artificial Sequence
  Description of Artificial Sequence: Synthetic oligonucleotide
gggcaauccucgagcaccc

SEQ ID NO: 733 - RNA, 19 nt, Artificial Sequence
  Description of Artificial Sequence: Synthetic oligonucleotide
ggugcucgaggauugcccg

SEQ ID NO: 734 - RNA, 19 nt, Artificial Sequence
  Description of Artificial Sequence: Synthetic oligonucleotide
cgggcaauccucgagcacc

SEQ ID NO: 735 - RNA, 19 nt, Artificial Sequence
  Description of Artificial Sequence: Synthetic oligonucleotide
gugcucgaggauugcccgg

SEQ ID NO: 736 - RNA, 19 nt, Artificial Sequence
  Description of Artificial Sequence: Synthetic oligonucleotide
ccgggcaauccucgagcac

SEQ ID NO: 737 - RNA, 19 nt, Artificial Sequence
  Description of Artificial Sequence: Synthetic oligonucleotide
ugcucgaggauugcccgga

SEQ ID NO: 738 - RNA, 19 nt, Artificial Sequence
  Description of Artificial Sequence: Synthetic oligonucleotide
uccgggcaauccucgagca

SEQ ID NO: 739 - RNA, 19 nt, Artificial Sequence
  Description of Artificial Sequence: Synthetic oligonucleotide
gcucgaggauugcccggaa

SEQ ID NO: 740 - RNA, 19 nt, Artificial Sequence
  Description of Artificial Sequence: Synthetic oligonucleotide
uuccgggcaauccucgagc

SEQ ID NO: 741 - RNA, 19 nt, Artificial Sequence
  Description of Artificial Sequence: Synthetic oligonucleotide
cucgaggauugcccggaac

SEQ ID NO: 742 - RNA, 19 nt, Artificial Sequence
  Description of Artificial Sequence: Synthetic oligonucleotide
guuccgggcaauccucgag

SEQ ID NO: 743 - RNA, 19 nt, Artificial Sequence
  Description of Artificial Sequence: Synthetic oligonucleotide
ucgaggauugcccggaaca

SEQ ID NO: 744 - RNA, 19 nt, Artificial Sequence
  Description of Artificial Sequence: Synthetic oligonucleotide
uguuccgggcaauccucga

SEQ ID NO: 745 - RNA, 19 nt, Artificial Sequence
  Description of Artificial Sequence: Synthetic oligonucleotide
uugcccggaacagcuggcc

SEQ ID NO: 746 - RNA, 19 nt, Artificial Sequence
  Description of Artificial Sequence: Synthetic oligonucleotide
ggccagcuguuccgggcaa

SEQ ID NO: 747 - RNA, 19 nt, Artificial Sequence
  Description of Artificial Sequence: Synthetic oligonucleotide
ggccucccuggaaugaagg

SEQ ID NO: 748 - RNA, 19 nt, Artificial Sequence
  Description of Artificial Sequence: Synthetic oligonucleotide
ccuucauuccagggaggcc

SEQ ID NO: 749 - RNA, 19 nt, Artificial Sequence
  Description of Artificial Sequence: Synthetic oligonucleotide
cucccuggaaugaagggac

SEQ ID NO: 750 - RNA, 19 nt, Artificial Sequence
  Description of Artificial Sequence: Synthetic oligonucleotide
gucccuucauuccagggag

SEQ ID NO: 751 - RNA, 19 nt, Artificial Sequence
  Description of Artificial Sequence: Synthetic oligonucleotide
ucccuggaaugaagggaca

SEQ ID NO: 752 - RNA, 19 nt, Artificial Sequence
  Description of Artificial Sequence: Synthetic oligonucleotide
ugucccuucauuccaggga

SEQ ID NO: 753 - RNA, 19 nt, Artificial Sequence
  Description of Artificial Sequence: Synthetic oligonucleotide
cuggaaugaagggacacag

SEQ ID NO: 754 - RNA, 19 nt, Artificial Sequence
  Description of Artificial Sequence: Synthetic oligonucleotide
cugugucccuucauuccag

SEQ ID NO: 755 - RNA, 19 nt, Artificial Sequence
  Description of Artificial Sequence: Synthetic oligonucleotide
acacagagguuucaguggu

SEQ ID NO: 756 - RNA, 19 nt, Artificial Sequence
  Description of Artificial Sequence: Synthetic oligonucleotide
accacugaaaccucugugu

SEQ ID NO: 757 - RNA, 19 nt, Artificial Sequence
  Description of Artificial Sequence: Synthetic oligonucleotide
acagagguuucagugguuu

SEQ ID NO: 758 - RNA, 19 nt, Artificial Sequence
  Description of Artificial Sequence: Synthetic oligonucleotide
aaaccacugaaaccucugu

SEQ ID NO: 759 - RNA, 19 nt, Artificial Sequence
  Description of Artificial Sequence: Synthetic oligonucleotide
cagagguuucagugguuug

SEQ ID NO: 760 - RNA, 19 nt, Artificial Sequence
  Description of Artificial Sequence: Synthetic oligonucleotide
caaaccacugaaaccucug

SEQ ID NO: 761 - RNA, 19 nt, Artificial Sequence
  Description of Artificial Sequence: Synthetic oligonucleotide
agagguuucagugguuugg

SEQ ID NO: 762 - RNA, 19 nt, Artificial Sequence
  Description of Artificial Sequence: Synthetic oligonucleotide
ccaaaccacugaaaccucu

SEQ ID NO: 763 - RNA, 19 nt, Artificial Sequence
  Description of Artificial Sequence: Synthetic oligonucleotide
gagguuucagugguuugga

SEQ ID NO: 764 - RNA, 19 nt, Artificial Sequence
  Description of Artificial Sequence: Synthetic oligonucleotide
uccaaaccacugaaaccuc

SEQ ID NO: 765 - RNA, 19 nt, Artificial Sequence
  Description of Artificial Sequence: Synthetic oligonucleotide
agguuucagugguuuggau

SEQ ID NO: 766 - RNA, 19 nt, Artificial Sequence
  Description of Artificial Sequence: Synthetic oligonucleotide
auccaaaccacugaaaccu

SEQ ID NO: 767 - RNA, 19 nt, Artificial Sequence
  Description of Artificial Sequence: Synthetic oligonucleotide
gguuucagugguuuggaug

SEQ ID NO: 768 - RNA, 19 nt, Artificial Sequence
  Description of Artificial Sequence: Synthetic oligonucleotide
cauccaaaccacugaaacc

SEQ ID NO: 769 - RNA, 19 nt, Artificial Sequence
  Description of Artificial Sequence: Synthetic oligonucleotide
guuucagugguuuggaugg

SEQ ID NO: 770 - RNA, 19 nt, Artificial Sequence
  Description of Artificial Sequence: Synthetic oligonucleotide
ccauccaaaccacugaaac

SEQ ID NO: 771 - RNA, 19 nt, Artificial Sequence
  Description of Artificial Sequence: Synthetic oligonucleotide
uuucagugguuuggauggu

SEQ ID NO: 772 - RNA, 19 nt, Artificial Sequence
  Description of Artificial Sequence: Synthetic oligonucleotide
accauccaaaccacugaaa

SEQ ID NO: 773 - RNA, 19 nt, Artificial Sequence
  Description of Artificial Sequence: Synthetic oligonucleotide
uucagugguuuggauggug

SEQ ID NO: 774 - RNA, 19 nt, Artificial Sequence
  Description of Artificial Sequence: Synthetic oligonucleotide
caccauccaaaccacugaa

SEQ ID NO: 775 - RNA, 19 nt, Artificial Sequence
  Description of Artificial Sequence: Synthetic oligonucleotide
gauggugccaagggagaug

SEQ ID NO: 776 - RNA, 19 nt, Artificial Sequence
  Description of Artificial Sequence: Synthetic oligonucleotide
caucucccuuggcaccauc

SEQ ID NO: 777 - RNA, 19 nt, Artificial Sequence
  Description of Artificial Sequence: Synthetic oligonucleotide
ugguccugcugguccuaag

SEQ ID NO: 778 - RNA, 19 nt, Artificial Sequence
  Description of Artificial Sequence: Synthetic oligonucleotide
cuuaggaccagcaggacca

SEQ ID NO: 779 - RNA, 19 nt, Artificial Sequence
  Description of Artificial Sequence: Synthetic oligonucleotide
gguccugcugguccuaagg

SEQ ID NO: 780 - RNA, 19 nt, Artificial Sequence
  Description of Artificial Sequence: Synthetic oligonucleotide
ccuuaggaccagcaggacc

SEQ ID NO: 781 - RNA, 19 nt, Artificial Sequence
  Description of Artificial Sequence: Synthetic oligonucleotide
ccugcugguccuaagggug

SEQ ID NO: 782 - RNA, 19 nt, Artificial Sequence
  Description of Artificial Sequence: Synthetic oligonucleotide
cacccuuaggaccagcagg

SEQ ID NO: 783 - RNA, 19 nt, Artificial Sequence
  Description of Artificial Sequence: Synthetic oligonucleotide
ugcugguccuaagggugag

SEQ ID NO: 784 - RNA, 19 nt, Artificial Sequence
  Description of Artificial Sequence: Synthetic oligonucleotide
cucacccuuaggaccagca

SEQ ID NO: 785 - RNA, 19 nt, Artificial Sequence
  Description of Artificial Sequence: Synthetic oligonucleotide
aaauggagcuccuggucag

SEQ ID NO: 786 - RNA, 19 nt, Artificial Sequence
  Description of Artificial Sequence: Synthetic oligonucleotide
cugaccaggagcuccauuu

SEQ ID NO: 787 - RNA, 19 nt, Artificial Sequence
  Description of Artificial Sequence: Synthetic oligonucleotide
aauggagcuccuggucaga

SEQ ID NO: 788 - RNA, 19 nt, Artificial Sequence
  Description of Artificial Sequence: Synthetic oligonucleotide
ucugaccaggagcuccauu

SEQ ID NO: 789 - RNA, 19 nt, Artificial Sequence
  Description of Artificial Sequence: Synthetic oligonucleotide
auggagcuccuggucagau

SEQ ID NO: 790 - RNA, 19 nt, Artificial Sequence
  Description of Artificial Sequence: Synthetic oligonucleotide
aucugaccaggagcuccau

SEQ ID NO: 791 - RNA, 19 nt, Artificial Sequence
  Description of Artificial Sequence: Synthetic oligonucleotide
ggucagaugggcccccgug

SEQ ID NO: 792 - RNA, 19 nt, Artificial Sequence
  Description of Artificial Sequence: Synthetic oligonucleotide
cacgggggcccaucugacc

SEQ ID NO: 793 - RNA, 19 nt, Artificial Sequence
  Description of Artificial Sequence: Synthetic oligonucleotide
gucagaugggcccccgugg

SEQ ID NO: 794 - RNA, 19 nt, Artificial Sequence
  Description of Artificial Sequence: Synthetic oligonucleotide
ccacgggggcccaucugac

SEQ ID NO: 795 - RNA, 19 nt, Artificial Sequence
  Description of Artificial Sequence: Synthetic oligonucleotide
ucagaugggcccccguggc

SEQ ID NO: 796 - RNA, 19 nt, Artificial Sequence
  Description of Artificial Sequence: Synthetic oligonucleotide
gccacgggggcccaucuga

SEQ ID NO: 797 - RNA, 19 nt, Artificial Sequence
  Description of Artificial Sequence: Synthetic oligonucleotide
agaugggcccccguggccu

SEQ ID NO: 798 - RNA, 19 nt, Artificial Sequence
  Description of Artificial Sequence: Synthetic oligonucleotide
aggccacgggggcccaucu

SEQ ID NO: 799 - RNA, 19 nt, Artificial Sequence
  Description of Artificial Sequence: Synthetic oligonucleotide
gaugggcccccguggccug

SEQ ID NO: 800 - RNA, 19 nt, Artificial Sequence
  Description of Artificial Sequence: Synthetic oligonucleotide
caggccacgggggcccauc

SEQ ID NO: 801 - RNA, 19 nt, Artificial Sequence
  Description of Artificial Sequence: Synthetic oligonucleotide
gccuggugagagaggucgc

SEQ ID NO: 802 - RNA, 19 nt, Artificial Sequence
  Description of Artificial Sequence: Synthetic oligonucleotide
gcgaccucucucaccaggc

SEQ ID NO: 803 - RNA, 19 nt, Artificial Sequence
  Description of Artificial Sequence: Synthetic oligonucleotide
ccuggugagagaggucgcc

SEQ ID NO: 804 - RNA, 19 nt, Artificial Sequence
  Description of Artificial Sequence: Synthetic oligonucleotide
ggcgaccucucucaccagg

SEQ ID NO: 805 - RNA, 19 nt, Artificial Sequence
  Description of Artificial Sequence: Synthetic oligonucleotide
cuggugagagaggucgccc

SEQ ID NO: 806 - RNA, 19 nt, Artificial Sequence
  Description of Artificial Sequence: Synthetic oligonucleotide
gggcgaccucucucaccag

SEQ ID NO: 807 - RNA, 19 nt, Artificial Sequence
  Description of Artificial Sequence: Synthetic oligonucleotide
uggugagagaggucgcccu

SEQ ID NO: 808 - RNA, 19 nt, Artificial Sequence
  Description of Artificial Sequence: Synthetic oligonucleotide
agggcgaccucucucacca

SEQ ID NO: 809 - RNA, 19 nt, Artificial Sequence
  Description of Artificial Sequence: Synthetic oligonucleotide
ggugagagaggucgcccug

SEQ ID NO: 810 - RNA, 19 nt, Artificial Sequence
  Description of Artificial Sequence: Synthetic oligonucleotide
cagggcgaccucucucacc

SEQ ID NO: 811 - RNA, 19 nt, Artificial Sequence
  Description of Artificial Sequence: Synthetic oligonucleotide
gcucguggaaaugauggug

SEQ ID NO: 812 - RNA, 19 nt, Artificial Sequence
  Description of Artificial Sequence: Synthetic oligonucleotide
caccaucauuuccacgagc

SEQ ID NO: 813 - RNA, 19 nt, Artificial Sequence
  Description of Artificial Sequence: Synthetic oligonucleotide
uggaaaugauggugcuacu

SEQ ID NO: 814 - RNA, 19 nt, Artificial Sequence
  Description of Artificial Sequence: Synthetic oligonucleotide
aguagcaccaucauuucca

SEQ ID NO: 815 - RNA, 19 nt, Artificial Sequence
  Description of Artificial Sequence: Synthetic oligonucleotide
ggaaaugauggugcuacug

SEQ ID NO: 816 - RNA, 19 nt, Artificial Sequence
  Description of Artificial Sequence: Synthetic oligonucleotide
caguagcaccaucauuucc

SEQ ID NO: 817 - RNA, 19 nt, Artificial Sequence
  Description of Artificial Sequence: Synthetic oligonucleotide
aaaugauggugcuacuggu

SEQ ID NO: 818 - RNA, 19 nt, Artificial Sequence
  Description of Artificial Sequence: Synthetic oligonucleotide
accaguagcaccaucauuu

SEQ ID NO: 819 - RNA, 19 nt, Artificial Sequence
  Description of Artificial Sequence: Synthetic oligonucleotide
aaugauggugcuacuggug

SEQ ID NO: 820 - RNA, 19 nt, Artificial Sequence
  Description of Artificial Sequence: Synthetic oligonucleotide
caccaguagcaccaucauu

SEQ ID NO: 821 - RNA, 19 nt, Artificial Sequence
  Description of Artificial Sequence: Synthetic oligonucleotide
ggugcuguuggugcuaagg

SEQ ID NO: 822 - RNA, 19 nt, Artificial Sequence
  Description of Artificial Sequence: Synthetic oligonucleotide
ccuuagcaccaacagcacc

SEQ ID NO: 823 - RNA, 19 nt, Artificial Sequence
  Description of Artificial Sequence: Synthetic oligonucleotide
gcuaagggugaagcugguc

SEQ ID NO: 824 - RNA, 19 nt, Artificial Sequence
  Description of Artificial Sequence: Synthetic oligonucleotide
gaccagcuucacccuuagc

SEQ ID NO: 825 - RNA, 19 nt, Artificial Sequence
  Description of Artificial Sequence: Synthetic oligonucleotide
cccaagggccccgaggcuc

SEQ ID NO: 826 - RNA, 19 nt, Artificial Sequence
  Description of Artificial Sequence: Synthetic oligonucleotide
gagccucggggcccuuggg

SEQ ID NO: 827 - RNA, 19 nt, Artificial Sequence
  Description of Artificial Sequence: Synthetic oligonucleotide
caagggccccgaggcucug

SEQ ID NO: 828 - RNA, 19 nt, Artificial Sequence
  Description of Artificial Sequence: Synthetic oligonucleotide
cagagccucggggcccuug

SEQ ID NO: 829 - RNA, 19 nt, Artificial Sequence
  Description of Artificial Sequence: Synthetic oligonucleotide
cccgaggcucugaaggucc

SEQ ID NO: 830 - RNA, 19 nt, Artificial Sequence
  Description of Artificial Sequence: Synthetic oligonucleotide
ggaccuucagagccucggg

SEQ ID NO: 831 - RNA, 19 nt, Artificial Sequence
  Description of Artificial Sequence: Synthetic oligonucleotide
cgaggcucugaaggucccc

SEQ ID NO: 832 - RNA, 19 nt, Artificial Sequence
  Description of Artificial Sequence: Synthetic oligonucleotide
ggggaccuucagagccucg

SEQ ID NO: 833 - RNA, 19 nt, Artificial Sequence
  Description of Artificial Sequence: Synthetic oligonucleotide
gaagguccccagggugugc

SEQ ID NO: 834 - RNA, 19 nt, Artificial Sequence
  Description of Artificial Sequence: Synthetic oligonucleotide
gcacacccuggggaccuuc

SEQ ID NO: 835 - RNA, 19 nt, Artificial Sequence
  Description of Artificial Sequence: Synthetic oligonucleotide
agguccccagggugugcgu

SEQ ID NO: 836 - RNA, 19 nt, Artificial Sequence
  Description of Artificial Sequence: Synthetic oligonucleotide
acgcacacccuggggaccu

SEQ ID NO: 837 - RNA, 19 nt, Artificial Sequence
  Description of Artificial Sequence: Synthetic oligonucleotide
ggcccugcuggaaacccug

SEQ ID NO: 838 - RNA, 19 nt, Artificial Sequence
  Description of Artificial Sequence: Synthetic oligonucleotide
caggguuuccagcagggcc

SEQ ID NO: 839 - RNA, 19 nt, Artificial Sequence
  Description of Artificial Sequence: Synthetic oligonucleotide
gaaacccuggugcugaugg

SEQ ID NO: 840 - RNA, 19 nt, Artificial Sequence
  Description of Artificial Sequence: Synthetic oligonucleotide
ccaucagcaccaggguuuc

SEQ ID NO: 841 - RNA, 19 nt, Artificial Sequence
  Description of Artificial Sequence: Synthetic oligonucleotide
acccuggugcugauggaca

SEQ ID NO: 842 - RNA, 19 nt, Artificial Sequence
  Description of Artificial Sequence: Synthetic oligonucleotide
uguccaucagcaccagggu

SEQ ID NO: 843 - RNA, 19 nt, Artificial Sequence
  Description of Artificial Sequence: Synthetic oligonucleotide
cagccuggugcuaaaggug

SEQ ID NO: 844 - RNA, 19 nt, Artificial Sequence
  Description of Artificial Sequence: Synthetic oligonucleotide
caccuuuagcaccaggcug

SEQ ID NO: 845 - RNA, 19 nt, Artificial Sequence
  Description of Artificial Sequence: Synthetic oligonucleotide
agccuggugcuaaaggugc

SEQ ID NO: 846 - RNA, 19 nt, Artificial Sequence
  Description of Artificial Sequence: Synthetic oligonucleotide
gcaccuuuagcaccaggcu

SEQ ID NO: 847 - RNA, 19 nt, Artificial Sequence
  Description of Artificial Sequence: Synthetic oligonucleotide
gcuaaaggugccaauggug

SEQ ID NO: 848 - RNA, 19 nt, Artificial Sequence
  Description of Artificial Sequence: Synthetic oligonucleotide
caccauuggcaccuuuagc

SEQ ID NO: 849 - RNA, 19 nt, Artificial Sequence
  Description of Artificial Sequence: Synthetic oligonucleotide
cuaaaggugccaauggugc

SEQ ID NO: 850 - RNA, 19 nt, Artificial Sequence
  Description of Artificial Sequence: Synthetic oligonucleotide
gcaccauuggcaccuuuag

SEQ ID NO: 851 - RNA, 19 nt, Artificial Sequence
  Description of Artificial Sequence: Synthetic oligonucleotide
ccaauggugcuccugguau

SEQ ID NO: 852 - RNA, 19 nt, Artificial Sequence
  Description of Artificial Sequence: Synthetic oligonucleotide
auaccaggagcaccauugg

SEQ ID NO: 853 - RNA, 19 nt, Artificial Sequence
  Description of Artificial Sequence: Synthetic oligonucleotide
auggugcuccugguauugc

SEQ ID NO: 854 - RNA, 19 nt, Artificial Sequence
  Description of Artificial Sequence: Synthetic oligonucleotide
gcaauaccaggagcaccau

SEQ ID NO: 855 - RNA, 19 nt, Artificial Sequence
  Description of Artificial Sequence: Synthetic oligonucleotide
ggugcuccugguauugcug

SEQ ID NO: 856 - RNA, 19 nt, Artificial Sequence
  Description of Artificial Sequence: Synthetic oligonucleotide
cagcaauaccaggagcacc

SEQ ID NO: 857 - RNA, 19 nt, Artificial Sequence
  Description of Artificial Sequence: Synthetic oligonucleotide
ggcuucccuggugcccgag

SEQ ID NO: 858 - RNA, 19 nt, Artificial Sequence
  Description of Artificial Sequence: Synthetic oligonucleotide
cucgggcaccagggaagcc

SEQ ID NO: 859 - RNA, 19 nt, Artificial Sequence
  Description of Artificial Sequence: Synthetic oligonucleotide
cuccuggucccaaggguaa

SEQ ID NO: 860 - RNA, 19 nt, Artificial Sequence
  Description of Artificial Sequence: Synthetic oligonucleotide
uuacccuugggaccaggag

SEQ ID NO: 861 - RNA, 19 nt, Artificial Sequence
  Description of Artificial Sequence: Synthetic oligonucleotide
cuggucccaaggguaacag

SEQ ID NO: 862 - RNA, 19 nt, Artificial Sequence
  Description of Artificial Sequence: Synthetic oligonucleotide
cuguuacccuugggaccag

SEQ ID NO: 863 - RNA, 19 nt, Artificial Sequence
  Description of Artificial Sequence: Synthetic oligonucleotide
uggucccaaggguaacagc

SEQ ID NO: 864 - RNA, 19 nt, Artificial Sequence
  Description of Artificial Sequence: Synthetic oligonucleotide
gcuguuacccuugggacca

SEQ ID NO: 865 - RNA, 19 nt, Artificial Sequence
  Description of Artificial Sequence: Synthetic oligonucleotide
ggucccaaggguaacagcg

SEQ ID NO: 866 - RNA, 19 nt, Artificial Sequence
  Description of Artificial Sequence: Synthetic oligonucleotide
cgcuguuacccuugggacc

SEQ ID NO: 867 - RNA, 19 nt, Artificial Sequence
  Description of Artificial Sequence: Synthetic oligonucleotide
gucccaaggguaacagcgg

SEQ ID NO: 868 - RNA, 19 nt, Artificial Sequence
  Description of Artificial Sequence: Synthetic oligonucleotide
ccgcuguuacccuugggac

SEQ ID NO: 869 - RNA, 19 nt, Artificial Sequence
  Description of Artificial Sequence: Synthetic oligonucleotide
ucccaaggguaacagcggu

SEQ ID NO: 870 - RNA, 19 nt, Artificial Sequence
  Description of Artificial Sequence: Synthetic oligonucleotide
accgcuguuacccuuggga

SEQ ID NO: 871 - RNA, 19 nt, Artificial Sequence
  Description of Artificial Sequence: Synthetic oligonucleotide
ccaaggguaacagcgguga

SEQ ID NO: 872 - RNA, 19 nt, Artificial Sequence
  Description of Artificial Sequence: Synthetic oligonucleotide
ucaccgcuguuacccuugg

SEQ ID NO: 873 - RNA, 19 nt, Artificial Sequence
  Description of Artificial Sequence: Synthetic oligonucleotide
caaggguaacagcggugaa

SEQ ID NO: 874 - RNA, 19 nt, Artificial Sequence
  Description of Artificial Sequence: Synthetic oligonucleotide
uucaccgcuguuacccuug

SEQ ID NO: 875 - RNA, 19 nt, Artificial Sequence
  Description of Artificial Sequence: Synthetic oligonucleotide
aaggguaacagcggugaac

SEQ ID NO: 876 - RNA, 19 nt, Artificial Sequence
  Description of Artificial Sequence: Synthetic oligonucleotide
guucaccgcuguuacccuu

SEQ ID NO: 877 - RNA, 19 nt, Artificial Sequence
  Description of Artificial Sequence: Synthetic oligonucleotide
aggguaacagcggugaacc

SEQ ID NO: 878 - RNA, 19 nt, Artificial Sequence
  Description of Artificial Sequence: Synthetic oligonucleotide
gguucaccgcuguuacccu

SEQ ID NO: 879 - RNA, 19 nt, Artificial Sequence
  Description of Artificial Sequence: Synthetic oligonucleotide
guaacagcggugaaccugg

SEQ ID NO: 880 - RNA, 19 nt, Artificial Sequence
  Description of Artificial Sequence: Synthetic oligonucleotide
ccagguucaccgcuguuac

SEQ ID NO: 881 - RNA, 19 nt, Artificial Sequence
  Description of Artificial Sequence: Synthetic oligonucleotide
gacacuggugcuaagggag

SEQ ID NO: 882 - RNA, 19 nt, Artificial Sequence
  Description of Artificial Sequence: Synthetic oligonucleotide
cucccuuagcaccaguguc

SEQ ID NO: 883 - RNA, 19 nt, Artificial Sequence
  Description of Artificial Sequence: Synthetic oligonucleotide
acacuggugcuaagggaga

SEQ ID NO: 884 - RNA, 19 nt, Artificial Sequence
  Description of Artificial Sequence: Synthetic oligonucleotide
ucucccuuagcaccagugu

SEQ ID NO: 885 - RNA, 19 nt, Artificial Sequence
  Description of Artificial Sequence: Synthetic oligonucleotide
guugguguucaaggacccc

SEQ ID NO: 886 - RNA, 19 nt, Artificial Sequence
  Description of Artificial Sequence: Synthetic oligonucleotide
gggguccuugaacaccaac

SEQ ID NO: 887 - RNA, 19 nt, Artificial Sequence
  Description of Artificial Sequence: Synthetic oligonucleotide
gagaggaaggaaagcgagg

SEQ ID NO: 888 - RNA, 19 nt, Artificial Sequence
  Description of Artificial Sequence: Synthetic oligonucleotide
ccucgcuuuccuuccucuc

SEQ ID NO: 889 - RNA, 19 nt, Artificial Sequence
  Description of Artificial Sequence: Synthetic oligonucleotide
aaggaaagcgaggagcucg

SEQ ID NO: 890 - RNA, 19 nt, Artificial Sequence
  Description of Artificial Sequence: Synthetic oligonucleotide
cgagcuccucgcuuuccuu

SEQ ID NO: 891 - RNA, 19 nt, Artificial Sequence
  Description of Artificial Sequence: Synthetic oligonucleotide
aggaaagcgaggagcucga

SEQ ID NO: 892 - RNA, 19 nt, Artificial Sequence
  Description of Artificial Sequence: Synthetic oligonucleotide
ucgagcuccucgcuuuccu

SEQ ID NO: 893 - RNA, 19 nt, Artificial Sequence
  Description of Artificial Sequence: Synthetic oligonucleotide
ggaaagcgaggagcucgag

SEQ ID NO: 894 - RNA, 19 nt, Artificial Sequence
  Description of Artificial Sequence: Synthetic oligonucleotide
cucgagcuccucgcuuucc

SEQ ID NO: 895 - RNA, 19 nt, Artificial Sequence
  Description of Artificial Sequence: Synthetic oligonucleotide
gaaagcgaggagcucgagg

SEQ ID NO: 896 - RNA, 19 nt, Artificial Sequence
  Description of Artificial Sequence: Synthetic oligonucleotide
ccucgagcuccucgcuuuc

SEQ ID NO: 897 - RNA, 19 nt, Artificial Sequence
  Description of Artificial Sequence: Synthetic oligonucleotide
aaagcgaggagcucgaggu

SEQ ID NO: 898 - RNA, 19 nt, Artificial Sequence
  Description of Artificial Sequence: Synthetic oligonucleotide
accucgagcuccucgcuuu

SEQ ID NO: 899 - RNA, 19 nt, Artificial Sequence
  Description of Artificial Sequence: Synthetic oligonucleotide
aagcgaggagcucgaggug

SEQ ID NO: 900 - RNA, 19 nt, Artificial Sequence
  Description of Artificial Sequence: Synthetic oligonucleotide
caccucgagcuccucgcuu

SEQ ID NO: 901 - RNA, 19 nt, Artificial Sequence
  Description of Artificial Sequence: Synthetic oligonucleotide
ggagcucgaggugaacccg

SEQ ID NO: 902 - RNA, 19 nt, Artificial Sequence
  Description of Artificial Sequence: Synthetic oligonucleotide
cggguucaccucgagcucc

SEQ ID NO: 903 - RNA, 19 nt, Artificial Sequence
  Description of Artificial Sequence: Synthetic oligonucleotide
gagcucgaggugaacccgg

SEQ ID NO: 904 - RNA, 19 nt, Artificial Sequence
  Description of Artificial Sequence: Synthetic oligonucleotide
ccggguucaccucgagcuc

SEQ ID NO: 905 - RNA, 19 nt, Artificial Sequence
  Description of Artificial Sequence: Synthetic oligonucleotide
cucgaggugaacccggacc

SEQ ID NO: 906 - RNA, 19 nt, Artificial Sequence
  Description of Artificial Sequence: Synthetic oligonucleotide
gguccggguucaccucgag

SEQ ID NO: 907 - RNA, 19 nt, Artificial Sequence
  Description of Artificial Sequence: Synthetic oligonucleotide
ucgaggugaacccggaccc

SEQ ID NO: 908 - RNA, 19 nt, Artificial Sequence
  Description of Artificial Sequence: Synthetic oligonucleotide
ggguccggguucaccucga

SEQ ID NO: 909 - RNA, 19 nt, Artificial Sequence
  Description of Artificial Sequence: Synthetic oligonucleotide
gaggugaacccggacccac

SEQ ID NO: 910 - RNA, 19 nt, Artificial Sequence
  Description of Artificial Sequence: Synthetic oligonucleotide
guggguccggguucaccuc

SEQ ID NO: 911 - RNA, 19 nt, Artificial Sequence
  Description of Artificial Sequence: Synthetic oligonucleotide
ggugaacccggacccacug

SEQ ID NO: 912 - RNA, 19 nt, Artificial Sequence
  Description of Artificial Sequence: Synthetic oligonucleotide
caguggguccggguucacc

SEQ ID NO: 913 - RNA, 19 nt, Artificial Sequence
  Description of Artificial Sequence: Synthetic oligonucleotide
gugaacccggacccacugg

SEQ ID NO: 914 - RNA, 19 nt, Artificial Sequence
  Description of Artificial Sequence: Synthetic oligonucleotide
ccaguggguccggguucac

SEQ ID NO: 915 - RNA, 19 nt, Artificial Sequence
  Description of Artificial Sequence: Synthetic oligonucleotide
gaacccggacccacuggcc

SEQ ID NO: 916 - RNA, 19 nt, Artificial Sequence
  Description of Artificial Sequence: Synthetic oligonucleotide
ggccaguggguccggguuc

SEQ ID NO: 917 - RNA, 19 nt, Artificial Sequence
  Description of Artificial Sequence: Synthetic oligonucleotide
ccggacccccuggcgagcg

SEQ ID NO: 918 - RNA, 19 nt, Artificial Sequence
  Description of Artificial Sequence: Synthetic oligonucleotide
cgcucgccaggggguccgg

SEQ ID NO: 919 - RNA, 19 nt, Artificial Sequence
  Description of Artificial Sequence: Synthetic oligonucleotide
cggacccccuggcgagcgu

SEQ ID NO: 920 - RNA, 19 nt, Artificial Sequence
  Description of Artificial Sequence: Synthetic oligonucleotide
acgcucgccaggggguccg

SEQ ID NO: 921 - RNA, 19 nt, Artificial Sequence
  Description of Artificial Sequence: Synthetic oligonucleotide
ggacccccuggcgagcgug

SEQ ID NO: 922 - RNA, 19 nt, Artificial Sequence
  Description of Artificial Sequence: Synthetic oligonucleotide
cacgcucgccagggggucc

SEQ ID NO: 923 - RNA, 19 nt, Artificial Sequence
  Description of Artificial Sequence: Synthetic oligonucleotide
uggcgagcgugguggaccu

SEQ ID NO: 924 - RNA, 19 nt, Artificial Sequence
  Description of Artificial Sequence: Synthetic oligonucleotide
agguccaccacgcucgcca

SEQ ID NO: 925 - RNA, 19 nt, Artificial Sequence
  Description of Artificial Sequence: Synthetic oligonucleotide
gcgagcgugguggaccugg

SEQ ID NO: 926 - RNA, 19 nt, Artificial Sequence
  Description of Artificial Sequence: Synthetic oligonucleotide
ccagguccaccacgcucgc

SEQ ID NO: 927 - RNA, 19 nt, Artificial Sequence
  Description of Artificial Sequence: Synthetic oligonucleotide
cgugguggaccugguagcc

SEQ ID NO: 928 - RNA, 19 nt, Artificial Sequence
  Description of Artificial Sequence: Synthetic oligonucleotide
ggcuaccagguccaccacg

SEQ ID NO: 929 - RNA, 19 nt, Artificial Sequence
  Description of Artificial Sequence: Synthetic oligonucleotide
ugguggaccugguagccgu

SEQ ID NO: 930 - RNA, 19 nt, Artificial Sequence
  Description of Artificial Sequence: Synthetic oligonucleotide
acggcuaccagguccacca

SEQ ID NO: 931 - RNA, 19 nt, Artificial Sequence
  Description of Artificial Sequence: Synthetic oligonucleotide
accugguagccgugguuuc

SEQ ID NO: 932 - RNA, 19 nt, Artificial Sequence
  Description of Artificial Sequence: Synthetic oligonucleotide
gaaaccacggcuaccaggu

SEQ ID NO: 933 - RNA, 19 nt, Artificial Sequence
  Description of Artificial Sequence: Synthetic oligonucleotide
ccugguagccgugguuucc

SEQ ID NO: 934 - RNA, 19 nt, Artificial Sequence
  Description of Artificial Sequence: Synthetic oligonucleotide
ggaaaccacggcuaccagg

SEQ ID NO: 935 - RNA, 19 nt, Artificial Sequence
  Description of Artificial Sequence: Synthetic oligonucleotide
cugguagccgugguuuccc

SEQ ID NO: 936 - RNA, 19 nt, Artificial Sequence
  Description of Artificial Sequence: Synthetic oligonucleotide
gggaaaccacggcuaccag

SEQ ID NO: 937 - RNA, 19 nt, Artificial Sequence
  Description of Artificial Sequence: Synthetic oligonucleotide
ugguagccgugguuucccu

SEQ ID NO: 938 - RNA, 19 nt, Artificial Sequence
  Description of Artificial Sequence: Synthetic oligonucleotide
agggaaaccacggcuacca

SEQ ID NO: 939 - RNA, 19 nt, Artificial Sequence
  Description of Artificial Sequence: Synthetic oligonucleotide
gguagccgugguuucccug

SEQ ID NO: 940 - RNA, 19 nt, Artificial Sequence
  Description of Artificial Sequence: Synthetic oligonucleotide
cagggaaaccacggcuacc

SEQ ID NO: 941 - RNA, 19 nt, Artificial Sequence
  Description of Artificial Sequence: Synthetic oligonucleotide
agccgugguuucccuggcg

SEQ ID NO: 942 - RNA, 19 nt, Artificial Sequence
  Description of Artificial Sequence: Synthetic oligonucleotide
cgccagggaaaccacggcu

SEQ ID NO: 943 - RNA, 19 nt, Artificial Sequence
  Description of Artificial Sequence: Synthetic oligonucleotide
ugguuucccuggcgcagau

SEQ ID NO: 944 - RNA, 19 nt, Artificial Sequence
  Description of Artificial Sequence: Synthetic oligonucleotide
aucugcgccagggaaacca

SEQ ID NO: 945 - RNA, 19 nt, Artificial Sequence
  Description of Artificial Sequence: Synthetic oligonucleotide
gguuucccuggcgcagaug

SEQ ID NO: 946 - RNA, 19 nt, Artificial Sequence
  Description of Artificial Sequence: Synthetic oligonucleotide
caucugcgccagggaaacc

SEQ ID NO: 947 - RNA, 19 nt, Artificial Sequence
  Description of Artificial Sequence: Synthetic oligonucleotide
uucccuggcgcagauggug

SEQ ID NO: 948 - RNA, 19 nt, Artificial Sequence
  Description of Artificial Sequence: Synthetic oligonucleotide
caccaucugcgccagggaa

SEQ ID NO: 949 - RNA, 19 nt, Artificial Sequence
  Description of Artificial Sequence: Synthetic oligonucleotide
ggcgcagaugguguugcug

SEQ ID NO: 950 - RNA, 19 nt, Artificial Sequence
  Description of Artificial Sequence: Synthetic oligonucleotide
cagcaacaccaucugcgcc

SEQ ID NO: 951 - RNA, 19 nt, Artificial Sequence
  Description of Artificial Sequence: Synthetic oligonucleotide
gcgcagaugguguugcugg

SEQ ID NO: 952 - RNA, 19 nt, Artificial Sequence
  Description of Artificial Sequence: Synthetic oligonucleotide
ccagcaacaccaucugcgc

SEQ ID NO: 953 - RNA, 19 nt, Artificial Sequence
  Description of Artificial Sequence: Synthetic oligonucleotide
cgcagaugguguugcuggu

SEQ ID NO: 954 - RNA, 19 nt, Artificial Sequence
  Description of Artificial Sequence: Synthetic oligonucleotide
accagcaacaccaucugcg

SEQ ID NO: 955 - RNA, 19 nt, Artificial Sequence
  Description of Artificial Sequence: Synthetic oligonucleotide
gguguugcuggucccaagg

SEQ ID NO: 956 - RNA, 19 nt, Artificial Sequence
  Description of Artificial Sequence: Synthetic oligonucleotide
ccuugggaccagcaacacc

SEQ ID NO: 957 - RNA, 19 nt, Artificial Sequence
  Description of Artificial Sequence: Synthetic oligonucleotide
guguugcuggucccaaggg

SEQ ID NO: 958 - RNA, 19 nt, Artificial Sequence
  Description of Artificial Sequence: Synthetic oligonucleotide
cccuugggaccagcaacac

SEQ ID NO: 959 - RNA, 19 nt, Artificial Sequence
  Description of Artificial Sequence: Synthetic oligonucleotide
uguugcuggucccaagggu

SEQ ID NO: 960 - RNA, 19 nt, Artificial Sequence
  Description of Artificial Sequence: Synthetic oligonucleotide
acccuugggaccagcaaca

SEQ ID NO: 961 - RNA, 19 nt, Artificial Sequence
  Description of Artificial Sequence: Synthetic oligonucleotide
guugcuggucccaaggguc

SEQ ID NO: 962 - RNA, 19 nt, Artificial Sequence
  Description of Artificial Sequence: Synthetic oligonucleotide
gacccuugggaccagcaac

SEQ ID NO: 963 - RNA, 19 nt, Artificial Sequence
  Description of Artificial Sequence: Synthetic oligonucleotide
ugcuggucccaaggguccc

SEQ ID NO: 964 - RNA, 19 nt, Artificial Sequence
  Description of Artificial Sequence: Synthetic oligonucleotide
gggacccuugggaccagca

SEQ ID NO: 965 - RNA, 19 nt, Artificial Sequence
  Description of Artificial Sequence: Synthetic oligonucleotide
uggucccaagggucccgcu

SEQ ID NO: 966 - RNA, 19 nt, Artificial Sequence
  Description of Artificial Sequence: Synthetic oligonucleotide
agcgggacccuugggacca

SEQ ID NO: 967 - RNA, 19 nt, Artificial Sequence
  Description of Artificial Sequence: Synthetic oligonucleotide
ggucccaagggucccgcug

SEQ ID NO: 968 - RNA, 19 nt, Artificial Sequence
  Description of Artificial Sequence: Synthetic oligonucleotide
cagcgggacccuugggacc

SEQ ID NO: 969 - RNA, 19 nt, Artificial Sequence
  Description of Artificial Sequence: Synthetic oligonucleotide
aagggucccgcuggugaac

SEQ ID NO: 970 - RNA, 19 nt, Artificial Sequence
  Description of Artificial Sequence: Synthetic oligonucleotide
guucaccagcgggacccuu

SEQ ID NO: 971 - RNA, 19 nt, Artificial Sequence
  Description of Artificial Sequence: Synthetic oligonucleotide
agggucccgcuggugaacg

SEQ ID NO: 972 - RNA, 19 nt, Artificial Sequence
  Description of Artificial Sequence: Synthetic oligonucleotide
cguucaccagcgggacccu

SEQ ID NO: 973 - RNA, 19 nt, Artificial Sequence
  Description of Artificial Sequence: Synthetic oligonucleotide
ggugaacgugguucuccug

SEQ ID NO: 974 - RNA, 19 nt, Artificial Sequence
  Description of Artificial Sequence: Synthetic oligonucleotide
caggagaaccacguucacc

SEQ ID NO: 975 - RNA, 19 nt, Artificial Sequence
  Description of Artificial Sequence: Synthetic oligonucleotide
gugaacgugguucuccugg

SEQ ID NO: 976 - RNA, 19 nt, Artificial Sequence
  Description of Artificial Sequence: Synthetic oligonucleotide
ccaggagaaccacguucac

SEQ ID NO: 977 - RNA, 19 nt, Artificial Sequence
  Description of Artificial Sequence: Synthetic oligonucleotide
gaucuccuggugaagcugg

SEQ ID NO: 978 - RNA, 19 nt, Artificial Sequence
  Description of Artificial Sequence: Synthetic oligonucleotide
ccagcuucaccaggagauc

SEQ ID NO: 979 - RNA, 19 nt, Artificial Sequence
  Description of Artificial Sequence: Synthetic oligonucleotide
ugaagcuggucgucccggu

SEQ ID NO: 980 - RNA, 19 nt, Artificial Sequence
  Description of Artificial Sequence: Synthetic oligonucleotide
accgggacgaccagcuuca

SEQ ID NO: 981 - RNA, 19 nt, Artificial Sequence
  Description of Artificial Sequence: Synthetic oligonucleotide
gaagcuggucgucccggug

SEQ ID NO: 982 - RNA, 19 nt, Artificial Sequence
  Description of Artificial Sequence: Synthetic oligonucleotide
caccgggacgaccagcuuc

SEQ ID NO: 983 - RNA, 19 nt, Artificial Sequence
  Description of Artificial Sequence: Synthetic oligonucleotide
aagcuggucgucccgguga

SEQ ID NO: 984 - RNA, 19 nt, Artificial Sequence
  Description of Artificial Sequence: Synthetic oligonucleotide
ucaccgggacgaccagcuu

SEQ ID NO: 985 - RNA, 19 nt, Artificial Sequence
  Description of Artificial Sequence: Synthetic oligonucleotide
agcuggucgucccggugaa

SEQ ID NO: 986 - RNA, 19 nt, Artificial Sequence
  Description of Artificial Sequence: Synthetic oligonucleotide
uucaccgggacgaccagcu

SEQ ID NO: 987 - RNA, 19 nt, Artificial Sequence
  Description of Artificial Sequence: Synthetic oligonucleotide
cgucccggugaagcugguc

SEQ ID NO: 988 - RNA, 19 nt, Artificial Sequence
  Description of Artificial Sequence: Synthetic oligonucleotide
gaccagcuucaccgggacg

SEQ ID NO: 989 - RNA, 19 nt, Artificial Sequence
  Description of Artificial Sequence: Synthetic oligonucleotide
cccggugaagcuggucugc

SEQ ID NO: 990 - RNA, 19 nt, Artificial Sequence
  Description of Artificial Sequence: Synthetic oligonucleotide
gcagaccagcuucaccggg

SEQ ID NO: 991 - RNA, 19 nt, Artificial Sequence
  Description of Artificial Sequence: Synthetic oligonucleotide
ugccuggugccaagggucu

SEQ ID NO: 992 - RNA, 19 nt, Artificial Sequence
  Description of Artificial Sequence: Synthetic oligonucleotide
agacccuuggcaccaggca

SEQ ID NO: 993 - RNA, 19 nt, Artificial Sequence
  Description of Artificial Sequence: Synthetic oligonucleotide
uggugccaagggucugacu

SEQ ID NO: 994 - RNA, 19 nt, Artificial Sequence
  Description of Artificial Sequence: Synthetic oligonucleotide
agucagacccuuggcacca

SEQ ID NO: 995 - RNA, 19 nt, Artificial Sequence
  Description of Artificial Sequence: Synthetic oligonucleotide
ggugccaagggucugacug

SEQ ID NO: 996 - RNA, 19 nt, Artificial Sequence
  Description of Artificial Sequence: Synthetic oligonucleotide
cagucagacccuuggcacc

SEQ ID NO: 997 - RNA, 19 nt, Artificial Sequence
  Description of Artificial Sequence: Synthetic oligonucleotide
gugccaagggucugacugg

SEQ ID NO: 998 - RNA, 19 nt, Artificial Sequence
  Description of Artificial Sequence: Synthetic oligonucleotide
ccagucagacccuuggcac

SEQ ID NO: 999 - RNA, 19 nt, Artificial Sequence
  Description of Artificial Sequence: Synthetic oligonucleotide
ugccaagggucugacugga

SEQ ID NO: 1000 - RNA, 19 nt, Artificial Sequence
  Description of Artificial Sequence: Synthetic oligonucleotide
uccagucagacccuuggca

SEQ ID NO: 1001 - RNA, 19 nt, Artificial Sequence
  Description of Artificial Sequence: Synthetic oligonucleotide
agggucugacuggaagccc

SEQ ID NO: 1002 - RNA, 19 nt, Artificial Sequence
  Description of Artificial Sequence: Synthetic oligonucleotide
gggcuuccagucagacccu

SEQ ID NO: 1003 - RNA, 19 nt, Artificial Sequence
  Description of Artificial Sequence: Synthetic oligonucleotide
gggucugacuggaagcccu

SEQ ID NO: 1004 - RNA, 19 nt, Artificial Sequence
  Description of Artificial Sequence: Synthetic oligonucleotide
agggcuuccagucagaccc

SEQ ID NO: 1005 - RNA, 19 nt, Artificial Sequence
  Description of Artificial Sequence: Synthetic oligonucleotide
ggcagcccugguccugaug

SEQ ID NO: 1006 - RNA, 19 nt, Artificial Sequence
  Description of Artificial Sequence: Synthetic oligonucleotide
caucaggaccagggcugcc

SEQ ID NO: 1007 - RNA, 19 nt, Artificial Sequence
  Description of Artificial Sequence: Synthetic oligonucleotide
cccugguccugauggcaaa

SEQ ID NO: 1008 - RNA, 19 nt, Artificial Sequence
  Description of Artificial Sequence: Synthetic oligonucleotide
uuugccaucaggaccaggg

SEQ ID NO: 1009 - RNA, 19 nt, Artificial Sequence
  Description of Artificial Sequence: Synthetic oligonucleotide
ugauggcaaaacuggcccc

SEQ ID NO: 1010 - RNA, 19 nt, Artificial Sequence
  Description of Artificial Sequence: Synthetic oligonucleotide
ggggccaguuuugccauca

SEQ ID NO: 1011 - RNA, 19 nt, Artificial Sequence
  Description of Artificial Sequence: Synthetic oligonucleotide
auggcaaaacuggcccccc

SEQ ID NO: 1012 - RNA, 19 nt, Artificial Sequence
  Description of Artificial Sequence: Synthetic oligonucleotide
ggggggccaguuuugccau

SEQ ID NO: 1013 - RNA, 19 nt, Artificial Sequence
  Description of Artificial Sequence: Synthetic oligonucleotide
cggucaagauggucgcccc

SEQ ID NO: 1014 - RNA, 19 nt, Artificial Sequence
  Description of Artificial Sequence: Synthetic oligonucleotide
ggggcgaccaucuugaccg

SEQ ID NO: 1015 - RNA, 19 nt, Artificial Sequence
  Description of Artificial Sequence: Synthetic oligonucleotide
ggucaagauggucgccccg

SEQ ID NO: 1016 - RNA, 19 nt, Artificial Sequence
  Description of Artificial Sequence: Synthetic oligonucleotide
cggggcgaccaucuugacc

SEQ ID NO: 1017 - RNA, 19 nt, Artificial Sequence
  Description of Artificial Sequence: Synthetic oligonucleotide
gucaagauggucgccccgg

SEQ ID NO: 1018 - RNA, 19 nt, Artificial Sequence
  Description of Artificial Sequence: Synthetic oligonucleotide
ccggggcgaccaucuugac

SEQ ID NO: 1019 - RNA, 19 nt, Artificial Sequence
  Description of Artificial Sequence: Synthetic oligonucleotide
ucaagauggucgccccgga

SEQ ID NO: 1020 - RNA, 19 nt, Artificial Sequence
  Description of Artificial Sequence: Synthetic oligonucleotide
uccggggcgaccaucuuga

SEQ ID NO: 1021 - RNA, 19 nt, Artificial Sequence
  Description of Artificial Sequence: Synthetic oligonucleotide
caagauggucgccccggac

SEQ ID NO: 1022 - RNA, 19 nt, Artificial Sequence
  Description of Artificial Sequence: Synthetic oligonucleotide
guccggggcgaccaucuug

SEQ ID NO: 1023 - RNA, 19 nt, Artificial Sequence
  Description of Artificial Sequence: Synthetic oligonucleotide
aagauggucgccccggacc

SEQ ID NO: 1024 - RNA, 19 nt, Artificial Sequence
  Description of Artificial Sequence: Synthetic oligonucleotide
gguccggggcgaccaucuu

SEQ ID NO: 1025 - RNA, 19 nt, Artificial Sequence
  Description of Artificial Sequence: Synthetic oligonucleotide
agauggucgccccggaccc

SEQ ID NO: 1026 - RNA, 19 nt, Artificial Sequence
  Description of Artificial Sequence: Synthetic oligonucleotide
ggguccggggcgaccaucu

SEQ ID NO: 1027 - RNA, 19 nt, Artificial Sequence
  Description of Artificial Sequence: Synthetic oligonucleotide
gauggucgccccggacccc

SEQ ID NO: 1028 - RNA, 19 nt, Artificial Sequence
  Description of Artificial Sequence: Synthetic oligonucleotide
gggguccggggcgaccauc

SEQ ID NO: 1029 - RNA, 19 nt, Artificial Sequence
  Description of Artificial Sequence: Synthetic oligonucleotide
accuggugcccguggucag

SEQ ID NO: 1030 - RNA, 19 nt, Artificial Sequence
  Description of Artificial Sequence: Synthetic oligonucleotide
cugaccacgggcaccaggu

SEQ ID NO: 1031 - RNA, 19 nt, Artificial Sequence
  Description of Artificial Sequence: Synthetic oligonucleotide
uggugcccguggucaggcu

SEQ ID NO: 1032 - RNA, 19 nt, Artificial Sequence
  Description of Artificial Sequence: Synthetic oligonucleotide
agccugaccacgggcacca

SEQ ID NO: 1033 - RNA, 19 nt, Artificial Sequence
  Description of Artificial Sequence: Synthetic oligonucleotide
uggucaggcuggugugaug

SEQ ID NO: 1034 - RNA, 19 nt, Artificial Sequence
  Description of Artificial Sequence: Synthetic oligonucleotide
caucacaccagccugacca

SEQ ID NO: 1035 - RNA, 19 nt, Artificial Sequence
  Description of Artificial Sequence: Synthetic oligonucleotide
caggcuggugugaugggau

SEQ ID NO: 1036 - RNA, 19 nt, Artificial Sequence
  Description of Artificial Sequence: Synthetic oligonucleotide
aucccaucacaccagccug

SEQ ID NO: 1037 - RNA, 19 nt, Artificial Sequence
  Description of Artificial Sequence: Synthetic oligonucleotide
gcuggugugaugggauucc

SEQ ID NO: 1038 - RNA, 19 nt, Artificial Sequence
  Description of Artificial Sequence: Synthetic oligonucleotide
ggaaucccaucacaccagc

SEQ ID NO: 1039 - RNA, 19 nt, Artificial Sequence
  Description of Artificial Sequence: Synthetic oligonucleotide
ggugugaugggauucccug

SEQ ID NO: 1040 - RNA, 19 nt, Artificial Sequence
  Description of Artificial Sequence: Synthetic oligonucleotide
cagggaaucccaucacacc

SEQ ID NO: 1041 - RNA, 19 nt, Artificial Sequence
  Description of Artificial Sequence: Synthetic oligonucleotide
gugaugggauucccuggac

SEQ ID NO: 1042 - RNA, 19 nt, Artificial Sequence
  Description of Artificial Sequence: Synthetic oligonucleotide
guccagggaaucccaucac

SEQ ID NO: 1043 - RNA, 19 nt, Artificial Sequence
  Description of Artificial Sequence: Synthetic oligonucleotide
ugaugggauucccuggacc

SEQ ID NO: 1044 - RNA, 19 nt, Artificial Sequence
  Description of Artificial Sequence: Synthetic oligonucleotide
gguccagggaaucccauca

SEQ ID NO: 1045 - RNA, 19 nt, Artificial Sequence
  Description of Artificial Sequence: Synthetic oligonucleotide
aaggcuggagagcgaggug

SEQ ID NO: 1046 - RNA, 19 nt, Artificial Sequence
  Description of Artificial Sequence: Synthetic oligonucleotide
caccucgcucuccagccuu

SEQ ID NO: 1047 - RNA, 19 nt, Artificial Sequence
  Description of Artificial Sequence: Synthetic oligonucleotide
ggcuggagagcgagguguu

SEQ ID NO: 1048 - RNA, 19 nt, Artificial Sequence
  Description of Artificial Sequence: Synthetic oligonucleotide
aacaccucgcucuccagcc

SEQ ID NO: 1049 - RNA, 19 nt, Artificial Sequence
  Description of Artificial Sequence: Synthetic oligonucleotide
agcgagguguucccggacc

SEQ ID NO: 1050 - RNA, 19 nt, Artificial Sequence
  Description of Artificial Sequence: Synthetic oligonucleotide
gguccgggaacaccucgcu

SEQ ID NO: 1051 - RNA, 19 nt, Artificial Sequence
  Description of Artificial Sequence: Synthetic oligonucleotide
ggacccccuggcgcugucg

SEQ ID NO: 1052 - RNA, 19 nt, Artificial Sequence
  Description of Artificial Sequence: Synthetic oligonucleotide
cgacagcgccagggggucc

SEQ ID NO: 1053 - RNA, 19 nt, Artificial Sequence
  Description of Artificial Sequence: Synthetic oligonucleotide
gacccccuggcgcugucgg

SEQ ID NO: 1054 - RNA, 19 nt, Artificial Sequence
  Description of Artificial Sequence: Synthetic oligonucleotide
ccgacagcgccaggggguc

SEQ ID NO: 1055 - RNA, 19 nt, Artificial Sequence
  Description of Artificial Sequence: Synthetic oligonucleotide
ccuggcgcugucgguccug

SEQ ID NO: 1056 - RNA, 19 nt, Artificial Sequence
  Description of Artificial Sequence: Synthetic oligonucleotide
caggaccgacagcgccagg

SEQ ID NO: 1057 - RNA, 19 nt, Artificial Sequence
  Description of Artificial Sequence: Synthetic oligonucleotide
uggcaaagauggagaggcu

SEQ ID NO: 1058 - RNA, 19 nt, Artificial Sequence
  Description of Artificial Sequence: Synthetic oligonucleotide
agccucuccaucuuugcca

SEQ ID NO: 1059 - RNA, 19 nt, Artificial Sequence
  Description of Artificial Sequence: Synthetic oligonucleotide
uggucccgcuggcgagaga

SEQ ID NO: 1060 - RNA, 19 nt, Artificial Sequence
  Description of Artificial Sequence: Synthetic oligonucleotide
ucucucgccagcgggacca

SEQ ID NO: 1061 - RNA, 19 nt, Artificial Sequence
  Description of Artificial Sequence: Synthetic oligonucleotide
ggucccgcuggcgagagag

SEQ ID NO: 1062 - RNA, 19 nt, Artificial Sequence
  Description of Artificial Sequence: Synthetic oligonucleotide
cucucucgccagcgggacc

SEQ ID NO: 1063 - RNA, 19 nt, Artificial Sequence
  Description of Artificial Sequence: Synthetic oligonucleotide
gucccgcuggcgagagagg

SEQ ID NO: 1064 - RNA, 19 nt, Artificial Sequence
  Description of Artificial Sequence: Synthetic oligonucleotide
ccucucucgccagcgggac

SEQ ID NO: 1065 - RNA, 19 nt, Artificial Sequence
  Description of Artificial Sequence: Synthetic oligonucleotide
ccgcuggcgagagagguga

SEQ ID NO: 1066 - RNA, 19 nt, Artificial Sequence
  Description of Artificial Sequence: Synthetic oligonucleotide
ucaccucucucgccagcgg

SEQ ID NO: 1067 - RNA, 19 nt, Artificial Sequence
  Description of Artificial Sequence: Synthetic oligonucleotide
cuggcucccccggauucca

SEQ ID NO: 1068 - RNA, 19 nt, Artificial Sequence
  Description of Artificial Sequence: Synthetic oligonucleotide
uggaauccgggggagccag

SEQ ID NO: 1069 - RNA, 19 nt, Artificial Sequence
  Description of Artificial Sequence: Synthetic oligonucleotide
uggcucccccggauuccag

SEQ ID NO: 1070 - RNA, 19 nt, Artificial Sequence
  Description of Artificial Sequence: Synthetic oligonucleotide
cuggaauccgggggagcca

SEQ ID NO: 1071 - RNA, 19 nt, Artificial Sequence
  Description of Artificial Sequence: Synthetic oligonucleotide
cccggauuccagggucucc

SEQ ID NO: 1072 - RNA, 19 nt, Artificial Sequence
  Description of Artificial Sequence: Synthetic oligonucleotide
ggagacccuggaauccggg

SEQ ID NO: 1073 - RNA, 19 nt, Artificial Sequence
  Description of Artificial Sequence: Synthetic oligonucleotide
cggauuccagggucucccu

SEQ ID NO: 1074 - RNA, 19 nt, Artificial Sequence
  Description of Artificial Sequence: Synthetic oligonucleotide
agggagacccuggaauccg

SEQ ID NO: 1075 - RNA, 19 nt, Artificial Sequence
  Description of Artificial Sequence: Synthetic oligonucleotide
uuccagggucucccugguc

SEQ ID NO: 1076 - RNA, 19 nt, Artificial Sequence
  Description of Artificial Sequence: Synthetic oligonucleotide
gaccagggagacccuggaa

SEQ ID NO: 1077 - RNA, 19 nt, Artificial Sequence
  Description of Artificial Sequence: Synthetic oligonucleotide
caggugaagcaggcaaacc

SEQ ID NO: 1078 - RNA, 19 nt, Artificial Sequence
  Description of Artificial Sequence: Synthetic oligonucleotide
gguuugccugcuucaccug

SEQ ID NO: 1079 - RNA, 19 nt, Artificial Sequence
  Description of Artificial Sequence: Synthetic oligonucleotide
aggugaagcaggcaaaccu

SEQ ID NO: 1080 - RNA, 19 nt, Artificial Sequence
  Description of Artificial Sequence: Synthetic oligonucleotide
agguuugccugcuucaccu

SEQ ID NO: 1081 - RNA, 19 nt, Artificial Sequence
  Description of Artificial Sequence: Synthetic oligonucleotide
ggugaagcaggcaaaccug

SEQ ID NO: 1082 - RNA, 19 nt, Artificial Sequence
  Description of Artificial Sequence: Synthetic oligonucleotide
cagguuugccugcuucacc

SEQ ID NO: 1083 - RNA, 19 nt, Artificial Sequence
  Description of Artificial Sequence: Synthetic oligonucleotide
gugaagcaggcaaaccugg

SEQ ID NO: 1084 - RNA, 19 nt, Artificial Sequence
  Description of Artificial Sequence: Synthetic oligonucleotide
ccagguuugccugcuucac

SEQ ID NO: 1085 - RNA, 19 nt, Artificial Sequence
  Description of Artificial Sequence: Synthetic oligonucleotide
gaagcaggcaaaccuggug

SEQ ID NO: 1086 - RNA, 19 nt, Artificial Sequence
  Description of Artificial Sequence: Synthetic oligonucleotide
caccagguuugccugcuuc

SEQ ID NO: 1087 - RNA, 19 nt, Artificial Sequence
  Description of Artificial Sequence: Synthetic oligonucleotide
aagcaggcaaaccugguga

SEQ ID NO: 1088 - RNA, 19 nt, Artificial Sequence
  Description of Artificial Sequence: Synthetic oligonucleotide
ucaccagguuugccugcuu

SEQ ID NO: 1089 - RNA, 19 nt, Artificial Sequence
  Description of Artificial Sequence: Synthetic oligonucleotide
agcaggcaaaccuggugaa

SEQ ID NO: 1090 - RNA, 19 nt, Artificial Sequence
  Description of Artificial Sequence: Synthetic oligonucleotide
uucaccagguuugccugcu

SEQ ID NO: 1091 - RNA, 19 nt, Artificial Sequence
  Description of Artificial Sequence: Synthetic oligonucleotide
ggguguuccuggagaccuu

SEQ ID NO: 1092 - RNA, 19 nt, Artificial Sequence
  Description of Artificial Sequence: Synthetic oligonucleotide
aaggucuccaggaacaccc

SEQ ID NO: 1093 - RNA, 19 nt, Artificial Sequence
  Description of Artificial Sequence: Synthetic oligonucleotide
uuggcgccccuggccccuc

SEQ ID NO: 1094 - RNA, 19 nt, Artificial Sequence
  Description of Artificial Sequence: Synthetic oligonucleotide
gaggggccaggggcgccaa

SEQ ID NO: 1095 - RNA, 19 nt, Artificial Sequence
  Description of Artificial Sequence: Synthetic oligonucleotide
ucuggagcaagaggcgaga

SEQ ID NO: 1096 - RNA, 19 nt, Artificial Sequence
  Description of Artificial Sequence: Synthetic oligonucleotide
ucucgccucuugcuccaga

SEQ ID NO: 1097 - RNA, 19 nt, Artificial Sequence
  Description of Artificial Sequence: Synthetic oligonucleotide
gaggcgagagagguuuccc

SEQ ID NO: 1098 - RNA, 19 nt, Artificial Sequence
  Description of Artificial Sequence: Synthetic oligonucleotide
gggaaaccucucucgccuc

SEQ ID NO: 1099 - RNA, 19 nt, Artificial Sequence
  Description of Artificial Sequence: Synthetic oligonucleotide
aggcgagagagguuucccu

SEQ ID NO: 1100 - RNA, 19 nt, Artificial Sequence
  Description of Artificial Sequence: Synthetic oligonucleotide
agggaaaccucucucgccu

SEQ ID NO: 1101 - RNA, 19 nt, Artificial Sequence
  Description of Artificial Sequence: Synthetic oligonucleotide
agagagguuucccuggcga

SEQ ID NO: 1102 - RNA, 19 nt, Artificial Sequence
  Description of Artificial Sequence: Synthetic oligonucleotide
ucgccagggaaaccucucu

SEQ ID NO: 1103 - RNA, 19 nt, Artificial Sequence
  Description of Artificial Sequence: Synthetic oligonucleotide
gagagguuucccuggcgag

SEQ ID NO: 1104 - RNA, 19 nt, Artificial Sequence
  Description of Artificial Sequence: Synthetic oligonucleotide
cucgccagggaaaccucuc

SEQ ID NO: 1105 - RNA, 19 nt, Artificial Sequence
  Description of Artificial Sequence: Synthetic oligonucleotide
agagguuucccuggcgagc

SEQ ID NO: 1106 - RNA, 19 nt, Artificial Sequence
  Description of Artificial Sequence: Synthetic oligonucleotide
gcucgccagggaaaccucu

SEQ ID NO: 1107 - RNA, 19 nt, Artificial Sequence
  Description of Artificial Sequence: Synthetic oligonucleotide
gagguuucccuggcgagcg

SEQ ID NO: 1108 - RNA, 19 nt, Artificial Sequence
  Description of Artificial Sequence: Synthetic oligonucleotide
cgcucgccagggaaaccuc

SEQ ID NO: 1109 - RNA, 19 nt, Artificial Sequence
  Description of Artificial Sequence: Synthetic oligonucleotide
agguuucccuggcgagcgu

SEQ ID NO: 1110 - RNA, 19 nt, Artificial Sequence
  Description of Artificial Sequence: Synthetic oligonucleotide
acgcucgccagggaaaccu

SEQ ID NO: 1111 - RNA, 19 nt, Artificial Sequence
  Description of Artificial Sequence: Synthetic oligonucleotide
guuucccuggcgagcgugg

SEQ ID NO: 1112 - RNA, 19 nt, Artificial Sequence
  Description of Artificial Sequence: Synthetic oligonucleotide
ccacgcucgccagggaaac

SEQ ID NO: 1113 - RNA, 19 nt, Artificial Sequence
  Description of Artificial Sequence: Synthetic oligonucleotide
uuucccuggcgagcguggu

SEQ ID NO: 1114 - RNA, 19 nt, Artificial Sequence
  Description of Artificial Sequence: Synthetic oligonucleotide
accacgcucgccagggaaa

SEQ ID NO: 1115 - RNA, 19 nt, Artificial Sequence
  Description of Artificial Sequence: Synthetic oligonucleotide
uucccuggcgagcguggug

SEQ ID NO: 1116 - RNA, 19 nt, Artificial Sequence
  Description of Artificial Sequence: Synthetic oligonucleotide
caccacgcucgccagggaa

SEQ ID NO: 1117 - RNA, 19 nt, Artificial Sequence
  Description of Artificial Sequence: Synthetic oligonucleotide
cccuggcgagcguggugug

SEQ ID NO: 1118 - RNA, 19 nt, Artificial Sequence
  Description of Artificial Sequence: Synthetic oligonucleotide
cacaccacgcucgccaggg

SEQ ID NO: 1119 - RNA, 19 nt, Artificial Sequence
  Description of Artificial Sequence: Synthetic oligonucleotide
ccuggcgagcguggugugc

SEQ ID NO: 1120 - RNA, 19 nt, Artificial Sequence
  Description of Artificial Sequence: Synthetic oligonucleotide
gcacaccacgcucgccagg

SEQ ID NO: 1121 - RNA, 19 nt, Artificial Sequence
  Description of Artificial Sequence: Synthetic oligonucleotide
cuggcgagcguggugugca

SEQ ID NO: 1122 - RNA, 19 nt, Artificial Sequence
  Description of Artificial Sequence: Synthetic oligonucleotide
ugcacaccacgcucgccag

SEQ ID NO: 1123 - RNA, 19 nt, Artificial Sequence
  Description of Artificial Sequence: Synthetic oligonucleotide
gcgagcguggugugcaagg

SEQ ID NO: 1124 - RNA, 19 nt, Artificial Sequence
  Description of Artificial Sequence: Synthetic oligonucleotide
ccuugcacaccacgcucgc

SEQ ID NO: 1125 - RNA, 19 nt, Artificial Sequence
  Description of Artificial Sequence: Synthetic oligonucleotide
ggugugcaaggucccccug

SEQ ID NO: 1126 - RNA, 19 nt, Artificial Sequence
  Description of Artificial Sequence: Synthetic oligonucleotide
cagggggaccuugcacacc

SEQ ID NO: 1127 - RNA, 19 nt, Artificial Sequence
  Description of Artificial Sequence: Synthetic oligonucleotide
gugugcaaggucccccugg

SEQ ID NO: 1128 - RNA, 19 nt, Artificial Sequence
  Description of Artificial Sequence: Synthetic oligonucleotide
ccagggggaccuugcacac

SEQ ID NO: 1129 - RNA, 19 nt, Artificial Sequence
  Description of Artificial Sequence: Synthetic oligonucleotide
gguccugcugguccccgag

SEQ ID NO: 1130 - RNA, 19 nt, Artificial Sequence
  Description of Artificial Sequence: Synthetic oligonucleotide
cucggggaccagcaggacc

SEQ ID NO: 1131 - RNA, 19 nt, Artificial Sequence
  Description of Artificial Sequence: Synthetic oligonucleotide
ugguccccgaggggccaac

SEQ ID NO: 1132 - RNA, 19 nt, Artificial Sequence
  Description of Artificial Sequence: Synthetic oligonucleotide
guuggccccucggggacca

SEQ ID NO: 1133 - RNA, 19 nt, Artificial Sequence
  Description of Artificial Sequence: Synthetic oligonucleotide
gguccccgaggggccaacg

SEQ ID NO: 1134 - RNA, 19 nt, Artificial Sequence
  Description of Artificial Sequence: Synthetic oligonucleotide
cguuggccccucggggacc

SEQ ID NO: 1135 - RNA, 19 nt, Artificial Sequence
  Description of Artificial Sequence: Synthetic oligonucleotide
ccccgaggggccaacggug

SEQ ID NO: 1136 - RNA, 19 nt, Artificial Sequence
  Description of Artificial Sequence: Synthetic oligonucleotide
caccguuggccccucgggg

SEQ ID NO: 1137 - RNA, 19 nt, Artificial Sequence
  Description of Artificial Sequence: Synthetic oligonucleotide
gggccaacggugcucccgg

SEQ ID NO: 1138 - RNA, 19 nt, Artificial Sequence
  Description of Artificial Sequence: Synthetic oligonucleotide
ccgggagcaccguuggccc

SEQ ID NO: 1139 - RNA, 19 nt, Artificial Sequence
  Description of Artificial Sequence: Synthetic oligonucleotide
ccaacggugcucccggcaa

SEQ ID NO: 1140 - RNA, 19 nt, Artificial Sequence
  Description of Artificial Sequence: Synthetic oligonucleotide
uugccgggagcaccguugg

SEQ ID NO: 1141 - RNA, 19 nt, Artificial Sequence
  Description of Artificial Sequence: Synthetic oligonucleotide
caacggugcucccggcaac

SEQ ID NO: 1142 - RNA, 19 nt, Artificial Sequence
  Description of Artificial Sequence: Synthetic oligonucleotide
guugccgggagcaccguug

SEQ ID NO: 1143 - RNA, 19 nt, Artificial Sequence
  Description of Artificial Sequence: Synthetic oligonucleotide
cggugcucccggcaacgau

SEQ ID NO: 1144 - RNA, 19 nt, Artificial Sequence
  Description of Artificial Sequence: Synthetic oligonucleotide
aucguugccgggagcaccg

SEQ ID NO: 1145 - RNA, 19 nt, Artificial Sequence
  Description of Artificial Sequence: Synthetic oligonucleotide
ggugcucccggcaacgaug

SEQ ID NO: 1146 - RNA, 19 nt, Artificial Sequence
  Description of Artificial Sequence: Synthetic oligonucleotide
caucguugccgggagcacc

SEQ ID NO: 1147 - RNA, 19 nt, Artificial Sequence
  Description of Artificial Sequence: Synthetic oligonucleotide
gcucccggcaacgauggug

SEQ ID NO: 1148 - RNA, 19 nt, Artificial Sequence
  Description of Artificial Sequence: Synthetic oligonucleotide
caccaucguugccgggagc

SEQ ID NO: 1149 - RNA, 19 nt, Artificial Sequence
  Description of Artificial Sequence: Synthetic oligonucleotide
cucccggcaacgauggugc

SEQ ID NO: 1150 - RNA, 19 nt, Artificial Sequence
  Description of Artificial Sequence: Synthetic oligonucleotide
gcaccaucguugccgggag

SEQ ID NO: 1151 - RNA, 19 nt, Artificial Sequence
  Description of Artificial Sequence: Synthetic oligonucleotide
auggugcuaagggugaugc

SEQ ID NO: 1152 - RNA, 19 nt, Artificial Sequence
  Description of Artificial Sequence: Synthetic oligonucleotide
gcaucacccuuagcaccau

SEQ ID NO: 1153 - RNA, 19 nt, Artificial Sequence
  Description of Artificial Sequence: Synthetic oligonucleotide
ccccuggagcucccgguag

SEQ ID NO: 1154 - RNA, 19 nt, Artificial Sequence
  Description of Artificial Sequence: Synthetic oligonucleotide
cuaccgggagcuccagggg

SEQ ID NO: 1155 - RNA, 19 nt, Artificial Sequence
  Description of Artificial Sequence: Synthetic oligonucleotide
cccuggagcucccgguagc

SEQ ID NO: 1156 - RNA, 19 nt, Artificial Sequence
  Description of Artificial Sequence: Synthetic oligonucleotide
gcuaccgggagcuccaggg

SEQ ID NO: 1157 - RNA, 19 nt, Artificial Sequence
  Description of Artificial Sequence: Synthetic oligonucleotide
ccuggagcucccgguagcc

SEQ ID NO: 1158 - RNA, 19 nt, Artificial Sequence
  Description of Artificial Sequence: Synthetic oligonucleotide
ggcuaccgggagcuccagg

SEQ ID NO: 1159 - RNA, 19 nt, Artificial Sequence
  Description of Artificial Sequence: Synthetic oligonucleotide
cuggagcucccgguagcca

SEQ ID NO: 1160 - RNA, 19 nt, Artificial Sequence
  Description of Artificial Sequence: Synthetic oligonucleotide
uggcuaccgggagcuccag

SEQ ID NO: 1161 - RNA, 19 nt, Artificial Sequence
  Description of Artificial Sequence: Synthetic oligonucleotide
ggucuuccagggccuaagg

SEQ ID NO: 1162 - RNA, 19 nt, Artificial Sequence
  Description of Artificial Sequence: Synthetic oligonucleotide
ccuuaggcccuggaagacc

SEQ ID NO: 1163 - RNA, 19 nt, Artificial Sequence
  Description of Artificial Sequence: Synthetic oligonucleotide
gucuuccagggccuaaggg

SEQ ID NO: 1164 - RNA, 19 nt, Artificial Sequence
  Description of Artificial Sequence: Synthetic oligonucleotide
cccuuaggcccuggaagac

SEQ ID NO: 1165 - RNA, 19 nt, Artificial Sequence
  Description of Artificial Sequence: Synthetic oligonucleotide
gugacagaggugaugcugg

SEQ ID NO: 1166 - RNA, 19 nt, Artificial Sequence
  Description of Artificial Sequence: Synthetic oligonucleotide
ccagcaucaccucugucac

SEQ ID NO: 1167 - RNA, 19 nt, Artificial Sequence
  Description of Artificial Sequence: Synthetic oligonucleotide
ggucccaaaggugcugaug

SEQ ID NO: 1168 - RNA, 19 nt, Artificial Sequence
  Description of Artificial Sequence: Synthetic oligonucleotide
caucagcaccuuugggacc

SEQ ID NO: 1169 - RNA, 19 nt, Artificial Sequence
  Description of Artificial Sequence: Synthetic oligonucleotide
ccaaaggugcugauggcuc

SEQ ID NO: 1170 - RNA, 19 nt, Artificial Sequence
  Description of Artificial Sequence: Synthetic oligonucleotide
gagccaucagcaccuuugg

SEQ ID NO: 1171 - RNA, 19 nt, Artificial Sequence
  Description of Artificial Sequence: Synthetic oligonucleotide
cuccuggcaaagauggcgu

SEQ ID NO: 1172 - RNA, 19 nt, Artificial Sequence
  Description of Artificial Sequence: Synthetic oligonucleotide
acgccaucuuugccaggag

SEQ ID NO: 1173 - RNA, 19 nt, Artificial Sequence
  Description of Artificial Sequence: Synthetic oligonucleotide
ggcaaagauggcguccgug

SEQ ID NO: 1174 - RNA, 19 nt, Artificial Sequence
  Description of Artificial Sequence: Synthetic oligonucleotide
cacggacgccaucuuugcc

SEQ ID NO: 1175 - RNA, 19 nt, Artificial Sequence
  Description of Artificial Sequence: Synthetic oligonucleotide
gcaaagauggcguccgugg

SEQ ID NO: 1176 - RNA, 19 nt, Artificial Sequence
  Description of Artificial Sequence: Synthetic oligonucleotide
ccacggacgccaucuuugc

SEQ ID NO: 1177 - RNA, 19 nt, Artificial Sequence
  Description of Artificial Sequence: Synthetic oligonucleotide
aaagauggcguccgugguc

SEQ ID NO: 1178 - RNA, 19 nt, Artificial Sequence
  Description of Artificial Sequence: Synthetic oligonucleotide
gaccacggacgccaucuuu

SEQ ID NO: 1179 - RNA, 19 nt, Artificial Sequence
  Description of Artificial Sequence: Synthetic oligonucleotide
aagauggcguccguggucu

SEQ ID NO: 1180 - RNA, 19 nt, Artificial Sequence
  Description of Artificial Sequence: Synthetic oligonucleotide
agaccacggacgccaucuu

SEQ ID NO: 1181 - RNA, 19 nt, Artificial Sequence
  Description of Artificial Sequence: Synthetic oligonucleotide
uggcguccguggucugacu

SEQ ID NO: 1182 - RNA, 19 nt, Artificial Sequence
  Description of Artificial Sequence: Synthetic oligonucleotide
agucagaccacggacgcca

SEQ ID NO: 1183 - RNA, 19 nt, Artificial Sequence
  Description of Artificial Sequence: Synthetic oligonucleotide
ggcguccguggucugacug

SEQ ID NO: 1184 - RNA, 19 nt, Artificial Sequence
  Description of Artificial Sequence: Synthetic oligonucleotide
cagucagaccacggacgcc

SEQ ID NO: 1185 - RNA, 19 nt, Artificial Sequence
  Description of Artificial Sequence: Synthetic oligonucleotide
guccguggucugacuggcc

SEQ ID NO: 1186 - RNA, 19 nt, Artificial Sequence
  Description of Artificial Sequence: Synthetic oligonucleotide
ggccagucagaccacggac

SEQ ID NO: 1187 - RNA, 19 nt, Artificial Sequence
  Description of Artificial Sequence: Synthetic oligonucleotide
uccguggucugacuggccc

SEQ ID NO: 1188 - RNA, 19 nt, Artificial Sequence
  Description of Artificial Sequence: Synthetic oligonucleotide
gggccagucagaccacgga

SEQ ID NO: 1189 - RNA, 19 nt, Artificial Sequence
  Description of Artificial Sequence: Synthetic oligonucleotide
uggucugacuggccccauu

SEQ ID NO: 1190 - RNA, 19 nt, Artificial Sequence
  Description of Artificial Sequence: Synthetic oligonucleotide
aauggggccagucagacca

SEQ ID NO: 1191 - RNA, 19 nt, Artificial Sequence
  Description of Artificial Sequence: Synthetic oligonucleotide
ggucugacuggccccauug

SEQ ID NO: 1192 - RNA, 19 nt, Artificial Sequence
  Description of Artificial Sequence: Synthetic oligonucleotide
caauggggccagucagacc

SEQ ID NO: 1193 - RNA, 19 nt, Artificial Sequence
  Description of Artificial Sequence: Synthetic oligonucleotide
caagggugaaagugguccc

SEQ ID NO: 1194 - RNA, 19 nt, Artificial Sequence
  Description of Artificial Sequence: Synthetic oligonucleotide
gggaccacuuucacccuug

SEQ ID NO: 1195 - RNA, 19 nt, Artificial Sequence
  Description of Artificial Sequence: Synthetic oligonucleotide
agggugaaaguggucccag

SEQ ID NO: 1196 - RNA, 19 nt, Artificial Sequence
  Description of Artificial Sequence: Synthetic oligonucleotide
cugggaccacuuucacccu

SEQ ID NO: 1197 - RNA, 19 nt, Artificial Sequence
  Description of Artificial Sequence: Synthetic oligonucleotide
gggugaaaguggucccagc

SEQ ID NO: 1198 - RNA, 19 nt, Artificial Sequence
  Description of Artificial Sequence: Synthetic oligonucleotide
gcugggaccacuuucaccc

SEQ ID NO: 1199 - RNA, 19 nt, Artificial Sequence
  Description of Artificial Sequence: Synthetic oligonucleotide
ggugaaaguggucccagcg

SEQ ID NO: 1200 - RNA, 19 nt, Artificial Sequence
  Description of Artificial Sequence: Synthetic oligonucleotide
cgcugggaccacuuucacc

SEQ ID NO: 1201 - RNA, 19 nt, Artificial Sequence
  Description of Artificial Sequence: Synthetic oligonucleotide
gugaaaguggucccagcgg

SEQ ID NO: 1202 - RNA, 19 nt, Artificial Sequence
  Description of Artificial Sequence: Synthetic oligonucleotide
ccgcugggaccacuuucac

SEQ ID NO: 1203 - RNA, 19 nt, Artificial Sequence
  Description of Artificial Sequence: Synthetic oligonucleotide
ugaaaguggucccagcggc

SEQ ID NO: 1204 - RNA, 19 nt, Artificial Sequence
  Description of Artificial Sequence: Synthetic oligonucleotide
gccgcugggaccacuuuca

SEQ ID NO: 1205 - RNA, 19 nt, Artificial Sequence
  Description of Artificial Sequence: Synthetic oligonucleotide
gaaaguggucccagcggcc

SEQ ID NO: 1206 - RNA, 19 nt, Artificial Sequence
  Description of Artificial Sequence: Synthetic oligonucleotide
ggccgcugggaccacuuuc

SEQ ID NO: 1207 - RNA, 19 nt, Artificial Sequence
  Description of Artificial Sequence: Synthetic oligonucleotide
aaaguggucccagcggccc

SEQ ID NO: 1208 - RNA, 19 nt, Artificial Sequence
  Description of Artificial Sequence: Synthetic oligonucleotide
gggccgcugggaccacuuu

SEQ ID NO: 1209 - RNA, 19 nt, Artificial Sequence
  Description of Artificial Sequence: Synthetic oligonucleotide
acuggagcucguggugccc

SEQ ID NO: 1210 - RNA, 19 nt, Artificial Sequence
  Description of Artificial Sequence: Synthetic oligonucleotide
gggcaccacgagcuccagu

SEQ ID NO: 1211 - RNA, 19 nt, Artificial Sequence
  Description of Artificial Sequence: Synthetic oligonucleotide
gcucguggugcccccggag

SEQ ID NO: 1212 - RNA, 19 nt, Artificial Sequence
  Description of Artificial Sequence: Synthetic oligonucleotide
cuccgggggcaccacgagc

SEQ ID NO: 1213 - RNA, 19 nt, Artificial Sequence
  Description of Artificial Sequence: Synthetic oligonucleotide
ucguggugcccccggagac

SEQ ID NO: 1214 - RNA, 19 nt, Artificial Sequence
  Description of Artificial Sequence: Synthetic oligonucleotide
gucuccgggggcaccacga

SEQ ID NO: 1215 - RNA, 19 nt, Artificial Sequence
  Description of Artificial Sequence: Synthetic oligonucleotide
cguggugcccccggagacc

SEQ ID NO: 1216 - RNA, 19 nt, Artificial Sequence
  Description of Artificial Sequence: Synthetic oligonucleotide
ggucuccgggggcaccacg

SEQ ID NO: 1217 - RNA, 19 nt, Artificial Sequence
  Description of Artificial Sequence: Synthetic oligonucleotide
uggugcccccggagaccgu

SEQ ID NO: 1218 - RNA, 19 nt, Artificial Sequence
  Description of Artificial Sequence: Synthetic oligonucleotide
acggucuccgggggcacca

SEQ ID NO: 1219 - RNA, 19 nt, Artificial Sequence
  Description of Artificial Sequence: Synthetic oligonucleotide
gaccguggugagccugguc

SEQ ID NO: 1220 - RNA, 19 nt, Artificial Sequence
  Description of Artificial Sequence: Synthetic oligonucleotide
gaccaggcucaccacgguc

SEQ ID NO: 1221 - RNA, 19 nt, Artificial Sequence
  Description of Artificial Sequence: Synthetic oligonucleotide
uggugcugacggccaaccu

SEQ ID NO: 1222 - RNA, 19 nt, Artificial Sequence
  Description of Artificial Sequence: Synthetic oligonucleotide
agguuggccgucagcacca

SEQ ID NO: 1223 - RNA, 19 nt, Artificial Sequence
  Description of Artificial Sequence: Synthetic oligonucleotide
cuggugcuaaaggcgaacc

SEQ ID NO: 1224 - RNA, 19 nt, Artificial Sequence
  Description of Artificial Sequence: Synthetic oligonucleotide
gguucgccuuuagcaccag

SEQ ID NO: 1225 - RNA, 19 nt, Artificial Sequence
  Description of Artificial Sequence: Synthetic oligonucleotide
uggugcuaaaggcgaaccu

SEQ ID NO: 1226 - RNA, 19 nt, Artificial Sequence
  Description of Artificial Sequence: Synthetic oligonucleotide
agguucgccuuuagcacca

SEQ ID NO: 1227 - RNA, 19 nt, Artificial Sequence
  Description of Artificial Sequence: Synthetic oligonucleotide
gugcuaaaggcgaaccugg

SEQ ID NO: 1228 - RNA, 19 nt, Artificial Sequence
  Description of Artificial Sequence: Synthetic oligonucleotide
ccagguucgccuuuagcac

SEQ ID NO: 1229 - RNA, 19 nt, Artificial Sequence
  Description of Artificial Sequence: Synthetic oligonucleotide
aaggcgaaccuggugaugc

SEQ ID NO: 1230 - RNA, 19 nt, Artificial Sequence
  Description of Artificial Sequence: Synthetic oligonucleotide
gcaucaccagguucgccuu

SEQ ID NO: 1231 - RNA, 19 nt, Artificial Sequence
  Description of Artificial Sequence: Synthetic oligonucleotide
uggugaugcuggugcuaaa

SEQ ID NO: 1232 - RNA, 19 nt, Artificial Sequence
  Description of Artificial Sequence: Synthetic oligonucleotide
uuuagcaccagcaucacca

SEQ ID NO: 1233 - RNA, 19 nt, Artificial Sequence
  Description of Artificial Sequence: Synthetic oligonucleotide
ggugaugcuggugcuaaag

SEQ ID NO: 1234 - RNA, 19 nt, Artificial Sequence
  Description of Artificial Sequence: Synthetic oligonucleotide
cuuuagcaccagcaucacc

SEQ ID NO: 1235 - RNA, 19 nt, Artificial Sequence
  Description of Artificial Sequence: Synthetic oligonucleotide
gugaugcuggugcuaaagg

SEQ ID NO: 1236 - RNA, 19 nt, Artificial Sequence
  Description of Artificial Sequence: Synthetic oligonucleotide
ccuuuagcaccagcaucac

SEQ ID NO: 1237 - RNA, 19 nt, Artificial Sequence
  Description of Artificial Sequence: Synthetic oligonucleotide
gaugcuggugcuaaaggcg

SEQ ID NO: 1238 - RNA, 19 nt, Artificial Sequence
  Description of Artificial Sequence: Synthetic oligonucleotide
cgccuuuagcaccagcauc

SEQ ID NO: 1239 - RNA, 19 nt, Artificial Sequence
  Description of Artificial Sequence: Synthetic oligonucleotide
cuggugcuaaaggcgaugc

SEQ ID NO: 1240 - RNA, 19 nt, Artificial Sequence
  Description of Artificial Sequence: Synthetic oligonucleotide
gcaucgccuuuagcaccag

SEQ ID NO: 1241 - RNA, 19 nt, Artificial Sequence
  Description of Artificial Sequence: Synthetic oligonucleotide
uggugcuaaaggcgaugcu

SEQ ID NO: 1242 - RNA, 19 nt, Artificial Sequence
  Description of Artificial Sequence: Synthetic oligonucleotide
agcaucgccuuuagcacca

SEQ ID NO: 1243 - RNA, 19 nt, Artificial Sequence
  Description of Artificial Sequence: Synthetic oligonucleotide
ggugcuaaaggcgaugcug

SEQ ID NO: 1244 - RNA, 19 nt, Artificial Sequence
  Description of Artificial Sequence: Synthetic oligonucleotide
cagcaucgccuuuagcacc

SEQ ID NO: 1245 - RNA, 19 nt, Artificial Sequence
  Description of Artificial Sequence: Synthetic oligonucleotide
ggcgaugcuggucccccug

SEQ ID NO: 1246 - RNA, 19 nt, Artificial Sequence
  Description of Artificial Sequence: Synthetic oligonucleotide
cagggggaccagcaucgcc

SEQ ID NO: 1247 - RNA, 19 nt, Artificial Sequence
  Description of Artificial Sequence: Synthetic oligonucleotide
ggcccugccggacccgcug

SEQ ID NO: 1248 - RNA, 19 nt, Artificial Sequence
  Description of Artificial Sequence: Synthetic oligonucleotide
cagcggguccggcagggcc

SEQ ID NO: 1249 - RNA, 19 nt, Artificial Sequence
  Description of Artificial Sequence: Synthetic oligonucleotide
ccugccggacccgcuggac

SEQ ID NO: 1250 - RNA, 19 nt, Artificial Sequence
  Description of Artificial Sequence: Synthetic oligonucleotide
guccagcggguccggcagg

SEQ ID NO: 1251 - RNA, 19 nt, Artificial Sequence
  Description of Artificial Sequence: Synthetic oligonucleotide
ccccuggccccauugguaa

SEQ ID NO: 1252 - RNA, 19 nt, Artificial Sequence
  Description of Artificial Sequence: Synthetic oligonucleotide
uuaccaauggggccagggg

SEQ ID NO: 1253 - RNA, 19 nt, Artificial Sequence
  Description of Artificial Sequence: Synthetic oligonucleotide
cccuggccccauugguaau

SEQ ID NO: 1254 - RNA, 19 nt, Artificial Sequence
  Description of Artificial Sequence: Synthetic oligonucleotide
auuaccaauggggccaggg

SEQ ID NO: 1255 - RNA, 19 nt, Artificial Sequence
  Description of Artificial Sequence: Synthetic oligonucleotide
ccuggccccauugguaaug

SEQ ID NO: 1256 - RNA, 19 nt, Artificial Sequence
  Description of Artificial Sequence: Synthetic oligonucleotide
cauuaccaauggggccagg

SEQ ID NO: 1257 - RNA, 19 nt, Artificial Sequence
  Description of Artificial Sequence: Synthetic oligonucleotide
cuggccccauugguaaugu

SEQ ID NO: 1258 - RNA, 19 nt, Artificial Sequence
  Description of Artificial Sequence: Synthetic oligonucleotide
acauuaccaauggggccag

SEQ ID NO: 1259 - RNA, 19 nt, Artificial Sequence
  Description of Artificial Sequence: Synthetic oligonucleotide
gccccauugguaauguugg

SEQ ID NO: 1260 - RNA, 19 nt, Artificial Sequence
  Description of Artificial Sequence: Synthetic oligonucleotide
ccaacauuaccaauggggc

SEQ ID NO: 1261 - RNA, 19 nt, Artificial Sequence
  Description of Artificial Sequence: Synthetic oligonucleotide
ccccauugguaauguuggu

SEQ ID NO: 1262 - RNA, 19 nt, Artificial Sequence
  Description of Artificial Sequence: Synthetic oligonucleotide
accaacauuaccaaugggg

SEQ ID NO: 1263 - RNA, 19 nt, Artificial Sequence
  Description of Artificial Sequence: Synthetic oligonucleotide
cccauugguaauguuggug

SEQ ID NO: 1264 - RNA, 19 nt, Artificial Sequence
  Description of Artificial Sequence: Synthetic oligonucleotide
caccaacauuaccaauggg

SEQ ID NO: 1265 - RNA, 19 nt, Artificial Sequence
  Description of Artificial Sequence: Synthetic oligonucleotide
cauugguaauguuggugcu

SEQ ID NO: 1266 - RNA, 19 nt, Artificial Sequence
  Description of Artificial Sequence: Synthetic oligonucleotide
agcaccaacauuaccaaug

SEQ ID NO: 1267 - RNA, 19 nt, Artificial Sequence
  Description of Artificial Sequence: Synthetic oligonucleotide
gcuccuggagccaaaggug

SEQ ID NO: 1268 - RNA, 19 nt, Artificial Sequence
  Description of Artificial Sequence: Synthetic oligonucleotide
caccuuuggcuccaggagc

SEQ ID NO: 1269 - RNA, 19 nt, Artificial Sequence
  Description of Artificial Sequence: Synthetic oligonucleotide
ggagccaaaggugcucgcg

SEQ ID NO: 1270 - RNA, 19 nt, Artificial Sequence
  Description of Artificial Sequence: Synthetic oligonucleotide
cgcgagcaccuuuggcucc

SEQ ID NO: 1271 - RNA, 19 nt, Artificial Sequence
  Description of Artificial Sequence: Synthetic oligonucleotide
gccaaaggugcucgcggca

SEQ ID NO: 1272 - RNA, 19 nt, Artificial Sequence
  Description of Artificial Sequence: Synthetic oligonucleotide
ugccgcgagcaccuuuggc

SEQ ID NO: 1273 - RNA, 19 nt, Artificial Sequence
  Description of Artificial Sequence: Synthetic oligonucleotide
ccaaaggugcucgcggcag

SEQ ID NO: 1274 - RNA, 19 nt, Artificial Sequence
  Description of Artificial Sequence: Synthetic oligonucleotide
cugccgcgagcaccuuugg

SEQ ID NO: 1275 - RNA, 19 nt, Artificial Sequence
  Description of Artificial Sequence: Synthetic oligonucleotide
aaggugcucgcggcagcgc

SEQ ID NO: 1276 - RNA, 19 nt, Artificial Sequence
  Description of Artificial Sequence: Synthetic oligonucleotide
gcgcugccgcgagcaccuu

SEQ ID NO: 1277 - RNA, 19 nt, Artificial Sequence
  Description of Artificial Sequence: Synthetic oligonucleotide
gugcucgcggcagcgcugg

SEQ ID NO: 1278 - RNA, 19 nt, Artificial Sequence
  Description of Artificial Sequence: Synthetic oligonucleotide
ccagcgcugccgcgagcac

SEQ ID NO: 1279 - RNA, 19 nt, Artificial Sequence
  Description of Artificial Sequence: Synthetic oligonucleotide
ggcagcgcuggucccccug

SEQ ID NO: 1280 - RNA, 19 nt, Artificial Sequence
  Description of Artificial Sequence: Synthetic oligonucleotide
cagggggaccagcgcugcc

SEQ ID NO: 1281 - RNA, 19 nt, Artificial Sequence
  Description of Artificial Sequence: Synthetic oligonucleotide
ggucccccuggugcuacug

SEQ ID NO: 1282 - RNA, 19 nt, Artificial Sequence
  Description of Artificial Sequence: Synthetic oligonucleotide
caguagcaccagggggacc

SEQ ID NO: 1283 - RNA, 19 nt, Artificial Sequence
  Description of Artificial Sequence: Synthetic oligonucleotide
gucccccuggugcuacugg

SEQ ID NO: 1284 - RNA, 19 nt, Artificial Sequence
  Description of Artificial Sequence: Synthetic oligonucleotide
ccaguagcaccagggggac

SEQ ID NO: 1285 - RNA, 19 nt, Artificial Sequence
  Description of Artificial Sequence: Synthetic oligonucleotide
ccccuggugcuacugguuu

SEQ ID NO: 1286 - RNA, 19 nt, Artificial Sequence
  Description of Artificial Sequence: Synthetic oligonucleotide
aaaccaguagcaccagggg

SEQ ID NO: 1287 - RNA, 19 nt, Artificial Sequence
  Description of Artificial Sequence: Synthetic oligonucleotide
cccuggugcuacugguuuc

SEQ ID NO: 1288 - RNA, 19 nt, Artificial Sequence
  Description of Artificial Sequence: Synthetic oligonucleotide
gaaaccaguagcaccaggg

SEQ ID NO: 1289 - RNA, 19 nt, Artificial Sequence
  Description of Artificial Sequence: Synthetic oligonucleotide
ugcuggccgagucgguccu

SEQ ID NO: 1290 - RNA, 19 nt, Artificial Sequence
  Description of Artificial Sequence: Synthetic oligonucleotide
aggaccgacucggccagca

SEQ ID NO: 1291 - RNA, 19 nt, Artificial Sequence
  Description of Artificial Sequence: Synthetic oligonucleotide
uggccgagucgguccuccu

SEQ ID NO: 1292 - RNA, 19 nt, Artificial Sequence
  Description of Artificial Sequence: Synthetic oligonucleotide
aggaggaccgacucggcca

SEQ ID NO: 1293 - RNA, 19 nt, Artificial Sequence
  Description of Artificial Sequence: Synthetic oligonucleotide
agucgguccuccuggcccc

SEQ ID NO: 1294 - RNA, 19 nt, Artificial Sequence
  Description of Artificial Sequence: Synthetic oligonucleotide
ggggccaggaggaccgacu

SEQ ID NO: 1295 - RNA, 19 nt, Artificial Sequence
  Description of Artificial Sequence: Synthetic oligonucleotide
gccccucuggaaaugcugg

SEQ ID NO: 1296 - RNA, 19 nt, Artificial Sequence
  Description of Artificial Sequence: Synthetic oligonucleotide
ccagcauuuccagaggggc

SEQ ID NO: 1297 - RNA, 19 nt, Artificial Sequence
  Description of Artificial Sequence: Synthetic oligonucleotide
ccugguccugcuggcaaag

SEQ ID NO: 1298 - RNA, 19 nt, Artificial Sequence
  Description of Artificial Sequence: Synthetic oligonucleotide
cuuugccagcaggaccagg

SEQ ID NO: 1299 - RNA, 19 nt, Artificial Sequence
  Description of Artificial Sequence: Synthetic oligonucleotide
uggcaaagaaggcggcaaa

SEQ ID NO: 1300 - RNA, 19 nt, Artificial Sequence
  Description of Artificial Sequence: Synthetic oligonucleotide
uuugccgccuucuuugcca

SEQ ID NO: 1301 - RNA, 19 nt, Artificial Sequence
  Description of Artificial Sequence: Synthetic oligonucleotide
agaaggcggcaaagguccc

SEQ ID NO: 1302 - RNA, 19 nt, Artificial Sequence
  Description of Artificial Sequence: Synthetic oligonucleotide
gggaccuuugccgccuucu

SEQ ID NO: 1303 - RNA, 19 nt, Artificial Sequence
  Description of Artificial Sequence: Synthetic oligonucleotide
gaaggcggcaaaggucccc

SEQ ID NO: 1304 - RNA, 19 nt, Artificial Sequence
  Description of Artificial Sequence: Synthetic oligonucleotide
ggggaccuuugccgccuuc

SEQ ID NO: 1305 - RNA, 19 nt, Artificial Sequence
  Description of Artificial Sequence: Synthetic oligonucleotide
aaggcggcaaagguccccg

SEQ ID NO: 1306 - RNA, 19 nt, Artificial Sequence
  Description of Artificial Sequence: Synthetic oligonucleotide
cggggaccuuugccgccuu

SEQ ID NO: 1307 - RNA, 19 nt, Artificial Sequence
  Description of Artificial Sequence: Synthetic oligonucleotide
gcggcaaagguccccgugg

SEQ ID NO: 1308 - RNA, 19 nt, Artificial Sequence
  Description of Artificial Sequence: Synthetic oligonucleotide
ccacggggaccuuugccgc

SEQ ID NO: 1309 - RNA, 19 nt, Artificial Sequence
  Description of Artificial Sequence: Synthetic oligonucleotide
cggcaaagguccccguggu

SEQ ID NO: 1310 - RNA, 19 nt, Artificial Sequence
  Description of Artificial Sequence: Synthetic oligonucleotide
accacggggaccuuugccg

SEQ ID NO: 1311 - RNA, 19 nt, Artificial Sequence
  Description of Artificial Sequence: Synthetic oligonucleotide
ggcaaagguccccguggug

SEQ ID NO: 1312 - RNA, 19 nt, Artificial Sequence
  Description of Artificial Sequence: Synthetic oligonucleotide
caccacggggaccuuugcc

SEQ ID NO: 1313 - RNA, 19 nt, Artificial Sequence
  Description of Artificial Sequence: Synthetic oligonucleotide
guccccguggugagacugg

SEQ ID NO: 1314 - RNA, 19 nt, Artificial Sequence
  Description of Artificial Sequence: Synthetic oligonucleotide
ccagucucaccacggggac

SEQ ID NO: 1315 - RNA, 19 nt, Artificial Sequence
  Description of Artificial Sequence: Synthetic oligonucleotide
ccguggugagacuggcccu

SEQ ID NO: 1316 - RNA, 19 nt, Artificial Sequence
  Description of Artificial Sequence: Synthetic oligonucleotide
agggccagucucaccacgg

SEQ ID NO: 1317 - RNA, 19 nt, Artificial Sequence
  Description of Artificial Sequence: Synthetic oligonucleotide
cguggugagacuggcccug

SEQ ID NO: 1318 - RNA, 19 nt, Artificial Sequence
  Description of Artificial Sequence: Synthetic oligonucleotide
cagggccagucucaccacg

SEQ ID NO: 1319 - RNA, 19 nt, Artificial Sequence
  Description of Artificial Sequence: Synthetic oligonucleotide
ggcccugcuggacguccug

SEQ ID NO: 1320 - RNA, 19 nt, Artificial Sequence
  Description of Artificial Sequence: Synthetic oligonucleotide
caggacguccagcagggcc

SEQ ID NO: 1321 - RNA, 19 nt, Artificial Sequence
  Description of Artificial Sequence: Synthetic oligonucleotide
ccugcuggacguccuggug

SEQ ID NO: 1322 - RNA, 19 nt, Artificial Sequence
  Description of Artificial Sequence: Synthetic oligonucleotide
caccaggacguccagcagg

SEQ ID NO: 1323 - RNA, 19 nt, Artificial Sequence
  Description of Artificial Sequence: Synthetic oligonucleotide
cguccuggugaaguugguc

SEQ ID NO: 1324 - RNA, 19 nt, Artificial Sequence
  Description of Artificial Sequence: Synthetic oligonucleotide
gaccaacuucaccaggacg

SEQ ID NO: 1325 - RNA, 19 nt, Artificial Sequence
  Description of Artificial Sequence: Synthetic oligonucleotide
guccuggugaaguuggucc

SEQ ID NO: 1326 - RNA, 19 nt, Artificial Sequence
  Description of Artificial Sequence: Synthetic oligonucleotide
ggaccaacuucaccaggac

SEQ ID NO: 1327 - RNA, 19 nt, Artificial Sequence
  Description of Artificial Sequence: Synthetic oligonucleotide
uccuggugaaguugguccc

SEQ ID NO: 1328 - RNA, 19 nt, Artificial Sequence
  Description of Artificial Sequence: Synthetic oligonucleotide
gggaccaacuucaccagga

SEQ ID NO: 1329 - RNA, 19 nt, Artificial Sequence
  Description of Artificial Sequence: Synthetic oligonucleotide
ccuggugaaguuggucccc

SEQ ID NO: 1330 - RNA, 19 nt, Artificial Sequence
  Description of Artificial Sequence: Synthetic oligonucleotide
ggggaccaacuucaccagg

SEQ ID NO: 1331 - RNA, 19 nt, Artificial Sequence
  Description of Artificial Sequence: Synthetic oligonucleotide
cuggugaaguugguccccc

SEQ ID NO: 1332 - RNA, 19 nt, Artificial Sequence
  Description of Artificial Sequence: Synthetic oligonucleotide
gggggaccaacuucaccag

SEQ ID NO: 1333 - RNA, 19 nt, Artificial Sequence
  Description of Artificial Sequence: Synthetic oligonucleotide
ggcccugcuggcgagaaag

SEQ ID NO: 1334 - RNA, 19 nt, Artificial Sequence
  Description of Artificial Sequence: Synthetic oligonucleotide
cuuucucgccagcagggcc

SEQ ID NO: 1335 - RNA, 19 nt, Artificial Sequence
  Description of Artificial Sequence: Synthetic oligonucleotide
cuggcgagaaaggaucccc

SEQ ID NO: 1336 - RNA, 19 nt, Artificial Sequence
  Description of Artificial Sequence: Synthetic oligonucleotide
ggggauccuuucucgccag

SEQ ID NO: 1337 - RNA, 19 nt, Artificial Sequence
  Description of Artificial Sequence: Synthetic oligonucleotide
uggcgagaaaggauccccu

SEQ ID NO: 1338 - RNA, 19 nt, Artificial Sequence
  Description of Artificial Sequence: Synthetic oligonucleotide
aggggauccuuucucgcca

SEQ ID NO: 1339 - RNA, 19 nt, Artificial Sequence
  Description of Artificial Sequence: Synthetic oligonucleotide
ggcgagaaaggauccccug

SEQ ID NO: 1340 - RNA, 19 nt, Artificial Sequence
  Description of Artificial Sequence: Synthetic oligonucleotide
caggggauccuuucucgcc

SEQ ID NO: 1341 - RNA, 19 nt, Artificial Sequence
  Description of Artificial Sequence: Synthetic oligonucleotide
ccgggccucaagguauugc

SEQ ID NO: 1342 - RNA, 19 nt, Artificial Sequence
  Description of Artificial Sequence: Synthetic oligonucleotide
gcaauaccuugaggcccgg

SEQ ID NO: 1343 - RNA, 19 nt, Artificial Sequence
  Description of Artificial Sequence: Synthetic oligonucleotide
cgggccucaagguauugcu

SEQ ID NO: 1344 - RNA, 19 nt, Artificial Sequence
  Description of Artificial Sequence: Synthetic oligonucleotide
agcaauaccuugaggcccg

SEQ ID NO: 1345 - RNA, 19 nt, Artificial Sequence
  Description of Artificial Sequence: Synthetic oligonucleotide
gggccucaagguauugcug

SEQ ID NO: 1346 - RNA, 19 nt, Artificial Sequence
  Description of Artificial Sequence: Synthetic oligonucleotide
cagcaauaccuugaggccc

SEQ ID NO: 1347 - RNA, 19 nt, Artificial Sequence
  Description of Artificial Sequence: Synthetic oligonucleotide
ggccucaagguauugcugg

SEQ ID NO: 1348 - RNA, 19 nt, Artificial Sequence
  Description of Artificial Sequence: Synthetic oligonucleotide
ccagcaauaccuugaggcc

SEQ ID NO: 1349 - RNA, 19 nt, Artificial Sequence
  Description of Artificial Sequence: Synthetic oligonucleotide
ccucaagguauugcuggac

SEQ ID NO: 1350 - RNA, 19 nt, Artificial Sequence
  Description of Artificial Sequence: Synthetic oligonucleotide
guccagcaauaccuugagg

SEQ ID NO: 1351 - RNA, 19 nt, Artificial Sequence
  Description of Artificial Sequence: Synthetic oligonucleotide
uauugcuggacagcguggu

SEQ ID NO: 1352 - RNA, 19 nt, Artificial Sequence
  Description of Artificial Sequence: Synthetic oligonucleotide
accacgcuguccagcaaua

SEQ ID NO: 1353 - RNA, 19 nt, Artificial Sequence
  Description of Artificial Sequence: Synthetic oligonucleotide
auugcuggacagcguggug

SEQ ID NO: 1354 - RNA, 19 nt, Artificial Sequence
  Description of Artificial Sequence: Synthetic oligonucleotide
caccacgcuguccagcaau

SEQ ID NO: 1355 - RNA, 19 nt, Artificial Sequence
  Description of Artificial Sequence: Synthetic oligonucleotide
acagcgugguguggucggc

SEQ ID NO: 1356 - RNA, 19 nt, Artificial Sequence
  Description of Artificial Sequence: Synthetic oligonucleotide
gccgaccacaccacgcugu

SEQ ID NO: 1357 - RNA, 19 nt, Artificial Sequence
  Description of Artificial Sequence: Synthetic oligonucleotide
cagcgugguguggucggcc

SEQ ID NO: 1358 - RNA, 19 nt, Artificial Sequence
  Description of Artificial Sequence: Synthetic oligonucleotide
ggccgaccacaccacgcug

SEQ ID NO: 1359 - RNA, 19 nt, Artificial Sequence
  Description of Artificial Sequence: Synthetic oligonucleotide
agcgugguguggucggccu

SEQ ID NO: 1360 - RNA, 19 nt, Artificial Sequence
  Description of Artificial Sequence: Synthetic oligonucleotide
aggccgaccacaccacgcu

SEQ ID NO: 1361 - RNA, 19 nt, Artificial Sequence
  Description of Artificial Sequence: Synthetic oligonucleotide
gcgugguguggucggccug

SEQ ID NO: 1362 - RNA, 19 nt, Artificial Sequence
  Description of Artificial Sequence: Synthetic oligonucleotide
caggccgaccacaccacgc

SEQ ID NO: 1363 - RNA, 19 nt, Artificial Sequence
  Description of Artificial Sequence: Synthetic oligonucleotide
cgugguguggucggccugc

SEQ ID NO: 1364 - RNA, 19 nt, Artificial Sequence
  Description of Artificial Sequence: Synthetic oligonucleotide
gcaggccgaccacaccacg

SEQ ID NO: 1365 - RNA, 19 nt, Artificial Sequence
  Description of Artificial Sequence: Synthetic oligonucleotide
gugguguggucggccugcc

SEQ ID NO: 1366 - RNA, 19 nt, Artificial Sequence
  Description of Artificial Sequence: Synthetic oligonucleotide
ggcaggccgaccacaccac

SEQ ID NO: 1367 - RNA, 19 nt, Artificial Sequence
  Description of Artificial Sequence: Synthetic oligonucleotide
guggucggccugccugguc

SEQ ID NO: 1368 - RNA, 19 nt, Artificial Sequence
  Description of Artificial Sequence: Synthetic oligonucleotide
gaccaggcaggccgaccac

SEQ ID NO: 1369 - RNA, 19 nt, Artificial Sequence
  Description of Artificial Sequence: Synthetic oligonucleotide
uggucggccugccugguca

SEQ ID NO: 1370 - RNA, 19 nt, Artificial Sequence
  Description of Artificial Sequence: Synthetic oligonucleotide
ugaccaggcaggccgacca

SEQ ID NO: 1371 - RNA, 19 nt, Artificial Sequence
  Description of Artificial Sequence: Synthetic oligonucleotide
cggccugccuggucagaga

SEQ ID NO: 1372 - RNA, 19 nt, Artificial Sequence
  Description of Artificial Sequence: Synthetic oligonucleotide
ucucugaccaggcaggccg

SEQ ID NO: 1373 - RNA, 19 nt, Artificial Sequence
  Description of Artificial Sequence: Synthetic oligonucleotide
ggccugccuggucagagag

SEQ ID NO: 1374 - RNA, 19 nt, Artificial Sequence
  Description of Artificial Sequence: Synthetic oligonucleotide
cucucugaccaggcaggcc

SEQ ID NO: 1375 - RNA, 19 nt, Artificial Sequence
  Description of Artificial Sequence: Synthetic oligonucleotide
gccugccuggucagagagg

SEQ ID NO: 1376 - RNA, 19 nt, Artificial Sequence
  Description of Artificial Sequence: Synthetic oligonucleotide
ccucucugaccaggcaggc

SEQ ID NO: 1377 - RNA, 19 nt, Artificial Sequence
  Description of Artificial Sequence: Synthetic oligonucleotide
ccuggucagagaggagaga

SEQ ID NO: 1378 - RNA, 19 nt, Artificial Sequence
  Description of Artificial Sequence: Synthetic oligonucleotide
ucucuccucucugaccagg

SEQ ID NO: 1379 - RNA, 19 nt, Artificial Sequence
  Description of Artificial Sequence: Synthetic oligonucleotide
gagagaggcuucccugguc

SEQ ID NO: 1380 - RNA, 19 nt, Artificial Sequence
  Description of Artificial Sequence: Synthetic oligonucleotide
gaccagggaagccucucuc

SEQ ID NO: 1381 - RNA, 19 nt, Artificial Sequence
  Description of Artificial Sequence: Synthetic oligonucleotide
gagaggcuucccuggucuu

SEQ ID NO: 1382 - RNA, 19 nt, Artificial Sequence
  Description of Artificial Sequence: Synthetic oligonucleotide
aagaccagggaagccucuc

SEQ ID NO: 1383 - RNA, 19 nt, Artificial Sequence
  Description of Artificial Sequence: Synthetic oligonucleotide
uggugaaccuggcaaacaa

SEQ ID NO: 1384 - RNA, 19 nt, Artificial Sequence
  Description of Artificial Sequence: Synthetic oligonucleotide
uuguuugccagguucacca

SEQ ID NO: 1385 - RNA, 19 nt, Artificial Sequence
  Description of Artificial Sequence: Synthetic oligonucleotide
aaccuggcaaacaaggucc

SEQ ID NO: 1386 - RNA, 19 nt, Artificial Sequence
  Description of Artificial Sequence: Synthetic oligonucleotide
ggaccuuguuugccagguu

SEQ ID NO: 1387 - RNA, 19 nt, Artificial Sequence
  Description of Artificial Sequence: Synthetic oligonucleotide
cuggcaaacaaggucccuc

SEQ ID NO: 1388 - RNA, 19 nt, Artificial Sequence
  Description of Artificial Sequence: Synthetic oligonucleotide
gagggaccuuguuugccag

SEQ ID NO: 1389 - RNA, 19 nt, Artificial Sequence
  Description of Artificial Sequence: Synthetic oligonucleotide
uggcaaacaaggucccucu

SEQ ID NO: 1390 - RNA, 19 nt, Artificial Sequence
  Description of Artificial Sequence: Synthetic oligonucleotide
agagggaccuuguuugcca

SEQ ID NO: 1391 - RNA, 19 nt, Artificial Sequence
  Description of Artificial Sequence: Synthetic oligonucleotide
ggcaaacaaggucccucug

SEQ ID NO: 1392 - RNA, 19 nt, Artificial Sequence
  Description of Artificial Sequence: Synthetic oligonucleotide
cagagggaccuuguuugcc

SEQ ID NO: 1393 - RNA, 19 nt, Artificial Sequence
  Description of Artificial Sequence: Synthetic oligonucleotide
caaacaaggucccucugga

SEQ ID NO: 1394 - RNA, 19 nt, Artificial Sequence
  Description of Artificial Sequence: Synthetic oligonucleotide
uccagagggaccuuguuug

SEQ ID NO: 1395 - RNA, 19 nt, Artificial Sequence
  Description of Artificial Sequence: Synthetic oligonucleotide
aggucccucuggagcaagu

SEQ ID NO: 1396 - RNA, 19 nt, Artificial Sequence
  Description of Artificial Sequence: Synthetic oligonucleotide
acuugcuccagagggaccu

SEQ ID NO: 1397 - RNA, 19 nt, Artificial Sequence
  Description of Artificial Sequence: Synthetic oligonucleotide
ucccucuggagcaaguggu

SEQ ID NO: 1398 - RNA, 19 nt, Artificial Sequence
  Description of Artificial Sequence: Synthetic oligonucleotide
accacuugcuccagaggga

SEQ ID NO: 1399 - RNA, 19 nt, Artificial Sequence
  Description of Artificial Sequence: Synthetic oligonucleotide
cccucuggagcaaguggug

SEQ ID NO: 1400 - RNA, 19 nt, Artificial Sequence
  Description of Artificial Sequence: Synthetic oligonucleotide
caccacuugcuccagaggg

SEQ ID NO: 1401 - RNA, 19 nt, Artificial Sequence
  Description of Artificial Sequence: Synthetic oligonucleotide
ggagcaaguggugaacgug

SEQ ID NO: 1402 - RNA, 19 nt, Artificial Sequence
  Description of Artificial Sequence: Synthetic oligonucleotide
cacguucaccacuugcucc

SEQ ID NO: 1403 - RNA, 19 nt, Artificial Sequence
  Description of Artificial Sequence: Synthetic oligonucleotide
gagcaaguggugaacgugg

SEQ ID NO: 1404 - RNA, 19 nt, Artificial Sequence
  Description of Artificial Sequence: Synthetic oligonucleotide
ccacguucaccacuugcuc

SEQ ID NO: 1405 - RNA, 19 nt, Artificial Sequence
  Description of Artificial Sequence: Synthetic oligonucleotide
agcaaguggugaacguggu

SEQ ID NO: 1406 - RNA, 19 nt, Artificial Sequence
  Description of Artificial Sequence: Synthetic oligonucleotide
accacguucaccacuugcu

SEQ ID NO: 1407 - RNA, 19 nt, Artificial Sequence
  Description of Artificial Sequence: Synthetic oligonucleotide
ggugaaucuggacgugagg

SEQ ID NO: 1408 - RNA, 19 nt, Artificial Sequence
  Description of Artificial Sequence: Synthetic oligonucleotide
ccucacguccagauucacc

SEQ ID NO: 1409 - RNA, 19 nt, Artificial Sequence
  Description of Artificial Sequence: Synthetic oligonucleotide
gugaaucuggacgugaggg

SEQ ID NO: 1410 - RNA, 19 nt, Artificial Sequence
  Description of Artificial Sequence: Synthetic oligonucleotide
cccucacguccagauucac

SEQ ID NO: 1411 - RNA, 19 nt, Artificial Sequence
  Description of Artificial Sequence: Synthetic oligonucleotide
ugaaucuggacgugagggg

SEQ ID NO: 1412 - RNA, 19 nt, Artificial Sequence
  Description of Artificial Sequence: Synthetic oligonucleotide
ccccucacguccagauuca

SEQ ID NO: 1413 - RNA, 19 nt, Artificial Sequence
  Description of Artificial Sequence: Synthetic oligonucleotide
gaaucuggacgugaggggg

SEQ ID NO: 1414 - RNA, 19 nt, Artificial Sequence
  Description of Artificial Sequence: Synthetic oligonucleotide
cccccucacguccagauuc

SEQ ID NO: 1415 - RNA, 19 nt, Artificial Sequence
  Description of Artificial Sequence: Synthetic oligonucleotide
aaucuggacgugagggggc

SEQ ID NO: 1416 - RNA, 19 nt, Artificial Sequence
  Description of Artificial Sequence: Synthetic oligonucleotide
gcccccucacguccagauu

SEQ ID NO: 1417 - RNA, 19 nt, Artificial Sequence
  Description of Artificial Sequence: Synthetic oligonucleotide
ucuggacgugagggggcuc

SEQ ID NO: 1418 - RNA, 19 nt, Artificial Sequence
  Description of Artificial Sequence: Synthetic oligonucleotide
gagcccccucacguccaga

SEQ ID NO: 1419 - RNA, 19 nt, Artificial Sequence
  Description of Artificial Sequence: Synthetic oligonucleotide
gggggcuccuggugccgaa

SEQ ID NO: 1420 - RNA, 19 nt, Artificial Sequence
  Description of Artificial Sequence: Synthetic oligonucleotide
uucggcaccaggagccccc

SEQ ID NO: 1421 - RNA, 19 nt, Artificial Sequence
  Description of Artificial Sequence: Synthetic oligonucleotide
ggggcuccuggugccgaag

SEQ ID NO: 1422 - RNA, 19 nt, Artificial Sequence
  Description of Artificial Sequence: Synthetic oligonucleotide
cuucggcaccaggagcccc

SEQ ID NO: 1423 - RNA, 19 nt, Artificial Sequence
  Description of Artificial Sequence: Synthetic oligonucleotide
gggcuccuggugccgaagg

SEQ ID NO: 1424 - RNA, 19 nt, Artificial Sequence
  Description of Artificial Sequence: Synthetic oligonucleotide
ccuucggcaccaggagccc

SEQ ID NO: 1425 - RNA, 19 nt, Artificial Sequence
  Description of Artificial Sequence: Synthetic oligonucleotide
gcuccuggugccgaagguu

SEQ ID NO: 1426 - RNA, 19 nt, Artificial Sequence
  Description of Artificial Sequence: Synthetic oligonucleotide
aaccuucggcaccaggagc

SEQ ID NO: 1427 - RNA, 19 nt, Artificial Sequence
  Description of Artificial Sequence: Synthetic oligonucleotide
cuccuggugccgaagguuc

SEQ ID NO: 1428 - RNA, 19 nt, Artificial Sequence
  Description of Artificial Sequence: Synthetic oligonucleotide
gaaccuucggcaccaggag

SEQ ID NO: 1429 - RNA, 19 nt, Artificial Sequence
  Description of Artificial Sequence: Synthetic oligonucleotide
cuggugccgaagguucccc

SEQ ID NO: 1430 - RNA, 19 nt, Artificial Sequence
  Description of Artificial Sequence: Synthetic oligonucleotide
ggggaaccuucggcaccag

SEQ ID NO: 1431 - RNA, 19 nt, Artificial Sequence
  Description of Artificial Sequence: Synthetic oligonucleotide
ggugccgaagguuccccug

SEQ ID NO: 1432 - RNA, 19 nt, Artificial Sequence
  Description of Artificial Sequence: Synthetic oligonucleotide
caggggaaccuucggcacc

SEQ ID NO: 1433 - RNA, 19 nt, Artificial Sequence
  Description of Artificial Sequence: Synthetic oligonucleotide
ccgaagguuccccuggacg

SEQ ID NO: 1434 - RNA, 19 nt, Artificial Sequence
  Description of Artificial Sequence: Synthetic oligonucleotide
cguccaggggaaccuucgg

SEQ ID NO: 1435 - RNA, 19 nt, Artificial Sequence
  Description of Artificial Sequence: Synthetic oligonucleotide
cgaagguuccccuggacga

SEQ ID NO: 1436 - RNA, 19 nt, Artificial Sequence
  Description of Artificial Sequence: Synthetic oligonucleotide
ucguccaggggaaccuucg

SEQ ID NO: 1437 - RNA, 19 nt, Artificial Sequence
  Description of Artificial Sequence: Synthetic oligonucleotide
gaagguuccccuggacgag

SEQ ID NO: 1438 - RNA, 19 nt, Artificial Sequence
  Description of Artificial Sequence: Synthetic oligonucleotide
cucguccaggggaaccuuc

SEQ ID NO: 1439 - RNA, 19 nt, Artificial Sequence
  Description of Artificial Sequence: Synthetic oligonucleotide
gguuccccuggacgagacg

SEQ ID NO: 1440 - RNA, 19 nt, Artificial Sequence
  Description of Artificial Sequence: Synthetic oligonucleotide
cgucucguccaggggaacc

SEQ ID NO: 1441 - RNA, 19 nt, Artificial Sequence
  Description of Artificial Sequence: Synthetic oligonucleotide
guuccccuggacgagacgg

SEQ ID NO: 1442 - RNA, 19 nt, Artificial Sequence
  Description of Artificial Sequence: Synthetic oligonucleotide
ccgucucguccaggggaac

SEQ ID NO: 1443 - RNA, 19 nt, Artificial Sequence
  Description of Artificial Sequence: Synthetic oligonucleotide
ccccuggacgagacgguuc

SEQ ID NO: 1444 - RNA, 19 nt, Artificial Sequence
  Description of Artificial Sequence: Synthetic oligonucleotide
gaaccgucucguccagggg

SEQ ID NO: 1445 - RNA, 19 nt, Artificial Sequence
  Description of Artificial Sequence: Synthetic oligonucleotide
cccuggacgagacgguucu

SEQ ID NO: 1446 - RNA, 19 nt, Artificial Sequence
  Description of Artificial Sequence: Synthetic oligonucleotide
agaaccgucucguccaggg

SEQ ID NO: 1447 - RNA, 19 nt, Artificial Sequence
  Description of Artificial Sequence: Synthetic oligonucleotide
ccuggacgagacgguucuc

SEQ ID NO: 1448 - RNA, 19 nt, Artificial Sequence
  Description of Artificial Sequence: Synthetic oligonucleotide
gagaaccgucucguccagg

SEQ ID NO: 1449 - RNA, 19 nt, Artificial Sequence
  Description of Artificial Sequence: Synthetic oligonucleotide
ggacgagacgguucuccug

SEQ ID NO: 1450 - RNA, 19 nt, Artificial Sequence
  Description of Artificial Sequence: Synthetic oligonucleotide
caggagaaccgucucgucc

SEQ ID NO: 1451 - RNA, 19 nt, Artificial Sequence
  Description of Artificial Sequence: Synthetic oligonucleotide
gacgagacgguucuccugg

SEQ ID NO: 1452 - RNA, 19 nt, Artificial Sequence
  Description of Artificial Sequence: Synthetic oligonucleotide
ccaggagaaccgucucguc

SEQ ID NO: 1453 - RNA, 19 nt, Artificial Sequence
  Description of Artificial Sequence: Synthetic oligonucleotide
gagacgguucuccuggcgc

SEQ ID NO: 1454 - RNA, 19 nt, Artificial Sequence
  Description of Artificial Sequence: Synthetic oligonucleotide
gcgccaggagaaccgucuc

SEQ ID NO: 1455 - RNA, 19 nt, Artificial Sequence
  Description of Artificial Sequence: Synthetic oligonucleotide
agacgguucuccuggcgcc

SEQ ID NO: 1456 - RNA, 19 nt, Artificial Sequence
  Description of Artificial Sequence: Synthetic oligonucleotide
ggcgccaggagaaccgucu

SEQ ID NO: 1457 - RNA, 19 nt, Artificial Sequence
  Description of Artificial Sequence: Synthetic oligonucleotide
gacgguucuccuggcgcca

SEQ ID NO: 1458 - RNA, 19 nt, Artificial Sequence
  Description of Artificial Sequence: Synthetic oligonucleotide
uggcgccaggagaaccguc

SEQ ID NO: 1459 - RNA, 19 nt, Artificial Sequence
  Description of Artificial Sequence: Synthetic oligonucleotide
acgguucuccuggcgccaa

SEQ ID NO: 1460 - RNA, 19 nt, Artificial Sequence
  Description of Artificial Sequence: Synthetic oligonucleotide
uuggcgccaggagaaccgu

SEQ ID NO: 1461 - RNA, 19 nt, Artificial Sequence
  Description of Artificial Sequence: Synthetic oligonucleotide
cgguucuccuggcgccaag

SEQ ID NO: 1462 - RNA, 19 nt, Artificial Sequence
  Description of Artificial Sequence: Synthetic oligonucleotide
cuuggcgccaggagaaccg

SEQ ID NO: 1463 - RNA, 19 nt, Artificial Sequence
  Description of Artificial Sequence: Synthetic oligonucleotide
guucuccuggcgccaaggg

SEQ ID NO: 1464 - RNA, 19 nt, Artificial Sequence
  Description of Artificial Sequence: Synthetic oligonucleotide
cccuuggcgccaggagaac

SEQ ID NO: 1465 - RNA, 19 nt, Artificial Sequence
  Description of Artificial Sequence: Synthetic oligonucleotide
gccaagggugaccguggug

SEQ ID NO: 1466 - RNA, 19 nt, Artificial Sequence
  Description of Artificial Sequence: Synthetic oligonucleotide
caccacggucacccuuggc

SEQ ID NO: 1467 - RNA, 19 nt, Artificial Sequence
  Description of Artificial Sequence: Synthetic oligonucleotide
ccaagggugaccgugguga

SEQ ID NO: 1468 - RNA, 19 nt, Artificial Sequence
  Description of Artificial Sequence: Synthetic oligonucleotide
ucaccacggucacccuugg

SEQ ID NO: 1469 - RNA, 19 nt, Artificial Sequence
  Description of Artificial Sequence: Synthetic oligonucleotide
gugaccguggugagaccgg

SEQ ID NO: 1470 - RNA, 19 nt, Artificial Sequence
  Description of Artificial Sequence: Synthetic oligonucleotide
ccggucucaccacggucac

SEQ ID NO: 1471 - RNA, 19 nt, Artificial Sequence
  Description of Artificial Sequence: Synthetic oligonucleotide
ugaccguggugagaccggc

SEQ ID NO: 1472 - RNA, 19 nt, Artificial Sequence
  Description of Artificial Sequence: Synthetic oligonucleotide
gccggucucaccacgguca

SEQ ID NO: 1473 - RNA, 19 nt, Artificial Sequence
  Description of Artificial Sequence: Synthetic oligonucleotide
gaccguggugagaccggcc

SEQ ID NO: 1474 - RNA, 19 nt, Artificial Sequence
  Description of Artificial Sequence: Synthetic oligonucleotide
ggccggucucaccacgguc

SEQ ID NO: 1475 - RNA, 19 nt, Artificial Sequence
  Description of Artificial Sequence: Synthetic oligonucleotide
accguggugagaccggccc

SEQ ID NO: 1476 - RNA, 19 nt, Artificial Sequence
  Description of Artificial Sequence: Synthetic oligonucleotide
gggccggucucaccacggu

SEQ ID NO: 1477 - RNA, 19 nt, Artificial Sequence
  Description of Artificial Sequence: Synthetic oligonucleotide
gugagaccggccccgcugg

SEQ ID NO: 1478 - RNA, 19 nt, Artificial Sequence
  Description of Artificial Sequence: Synthetic oligonucleotide
ccagcggggccggucucac

SEQ ID NO: 1479 - RNA, 19 nt, Artificial Sequence
  Description of Artificial Sequence: Synthetic oligonucleotide
agaccggccccgcuggacc

SEQ ID NO: 1480 - RNA, 19 nt, Artificial Sequence
  Description of Artificial Sequence: Synthetic oligonucleotide
gguccagcggggccggucu

SEQ ID NO: 1481 - RNA, 19 nt, Artificial Sequence
  Description of Artificial Sequence: Synthetic oligonucleotide
ggugccccuggccccguug

SEQ ID NO: 1482 - RNA, 19 nt, Artificial Sequence
  Description of Artificial Sequence: Synthetic oligonucleotide
caacggggccaggggcacc

SEQ ID NO: 1483 - RNA, 19 nt, Artificial Sequence
  Description of Artificial Sequence: Synthetic oligonucleotide
ggcaagaguggugaucgug

SEQ ID NO: 1484 - RNA, 19 nt, Artificial Sequence
  Description of Artificial Sequence: Synthetic oligonucleotide
cacgaucaccacucuugcc

SEQ ID NO: 1485 - RNA, 19 nt, Artificial Sequence
  Description of Artificial Sequence: Synthetic oligonucleotide
gcaagaguggugaucgugg

SEQ ID NO: 1486 - RNA, 19 nt, Artificial Sequence
  Description of Artificial Sequence: Synthetic oligonucleotide
ccacgaucaccacucuugc

SEQ ID NO: 1487 - RNA, 19 nt, Artificial Sequence
  Description of Artificial Sequence: Synthetic oligonucleotide
caagaguggugaucguggu

SEQ ID NO: 1488 - RNA, 19 nt, Artificial Sequence
  Description of Artificial Sequence: Synthetic oligonucleotide
accacgaucaccacucuug

SEQ ID NO: 1489 - RNA, 19 nt, Artificial Sequence
  Description of Artificial Sequence: Synthetic oligonucleotide
aagaguggugaucguggug

SEQ ID NO: 1490 - RNA, 19 nt, Artificial Sequence
  Description of Artificial Sequence: Synthetic oligonucleotide
caccacgaucaccacucuu

SEQ ID NO: 1491 - RNA, 19 nt, Artificial Sequence
  Description of Artificial Sequence: Synthetic oligonucleotide
aucguggugagacuggucc

SEQ ID NO: 1492 - RNA, 19 nt, Artificial Sequence
  Description of Artificial Sequence: Synthetic oligonucleotide
ggaccagucucaccacgau

SEQ ID NO: 1493 - RNA, 19 nt, Artificial Sequence
  Description of Artificial Sequence: Synthetic oligonucleotide
guggugagacugguccugc

SEQ ID NO: 1494 - RNA, 19 nt, Artificial Sequence
  Description of Artificial Sequence: Synthetic oligonucleotide
gcaggaccagucucaccac

SEQ ID NO: 1495 - RNA, 19 nt, Artificial Sequence
  Description of Artificial Sequence: Synthetic oligonucleotide
ggucccgccgguccugucg

SEQ ID NO: 1496 - RNA, 19 nt, Artificial Sequence
  Description of Artificial Sequence: Synthetic oligonucleotide
cgacaggaccggcgggacc

SEQ ID NO: 1497 - RNA, 19 nt, Artificial Sequence
  Description of Artificial Sequence: Synthetic oligonucleotide
gucccgccgguccugucgg

SEQ ID NO: 1498 - RNA, 19 nt, Artificial Sequence
  Description of Artificial Sequence: Synthetic oligonucleotide
ccgacaggaccggcgggac

SEQ ID NO: 1499 - RNA, 19 nt, Artificial Sequence
  Description of Artificial Sequence: Synthetic oligonucleotide
cgccgguccugucggcccu

SEQ ID NO: 1500 - RNA, 19 nt, Artificial Sequence
  Description of Artificial Sequence: Synthetic oligonucleotide
agggccgacaggaccggcg

SEQ ID NO: 1501 - RNA, 19 nt, Artificial Sequence
  Description of Artificial Sequence: Synthetic oligonucleotide
gccgguccugucggcccug

SEQ ID NO: 1502 - RNA, 19 nt, Artificial Sequence
  Description of Artificial Sequence: Synthetic oligonucleotide
cagggccgacaggaccggc

SEQ ID NO: 1503 - RNA, 19 nt, Artificial Sequence
  Description of Artificial Sequence: Synthetic oligonucleotide
uccugucggcccuguuggc

SEQ ID NO: 1504 - RNA, 19 nt, Artificial Sequence
  Description of Artificial Sequence: Synthetic oligonucleotide
gccaacagggccgacagga

SEQ ID NO: 1505 - RNA, 19 nt, Artificial Sequence
  Description of Artificial Sequence: Synthetic oligonucleotide
uguuggcgcccguggcccc

SEQ ID NO: 1506 - RNA, 19 nt, Artificial Sequence
  Description of Artificial Sequence: Synthetic oligonucleotide
ggggccacgggcgccaaca

SEQ ID NO: 1507 - RNA, 19 nt, Artificial Sequence
  Description of Artificial Sequence: Synthetic oligonucleotide
ggcccccguggugacaagg

SEQ ID NO: 1508 - RNA, 19 nt, Artificial Sequence
  Description of Artificial Sequence: Synthetic oligonucleotide
ccuugucaccacgggggcc

SEQ ID NO: 1509 - RNA, 19 nt, Artificial Sequence
  Description of Artificial Sequence: Synthetic oligonucleotide
gcccccguggugacaaggg

SEQ ID NO: 1510 - RNA, 19 nt, Artificial Sequence
  Description of Artificial Sequence: Synthetic oligonucleotide
cccuugucaccacgggggc

SEQ ID NO: 1511 - RNA, 19 nt, Artificial Sequence
  Description of Artificial Sequence: Synthetic oligonucleotide
cccguggugacaaggguga

SEQ ID NO: 1512 - RNA, 19 nt, Artificial Sequence
  Description of Artificial Sequence: Synthetic oligonucleotide
ucacccuugucaccacggg

SEQ ID NO: 1513 - RNA, 19 nt, Artificial Sequence
  Description of Artificial Sequence: Synthetic oligonucleotide
acaagggugagacaggcga

SEQ ID NO: 1514 - RNA, 19 nt, Artificial Sequence
  Description of Artificial Sequence: Synthetic oligonucleotide
ucgccugucucacccuugu

SEQ ID NO: 1515 - RNA, 19 nt, Artificial Sequence
  Description of Artificial Sequence: Synthetic oligonucleotide
agggugagacaggcgaaca

SEQ ID NO: 1516 - RNA, 19 nt, Artificial Sequence
  Description of Artificial Sequence: Synthetic oligonucleotide
uguucgccugucucacccu

SEQ ID NO: 1517 - RNA, 19 nt, Artificial Sequence
  Description of Artificial Sequence: Synthetic oligonucleotide
gggugagacaggcgaacag

SEQ ID NO: 1518 - RNA, 19 nt, Artificial Sequence
  Description of Artificial Sequence: Synthetic oligonucleotide
cuguucgccugucucaccc

SEQ ID NO: 1519 - RNA, 19 nt, Artificial Sequence
  Description of Artificial Sequence: Synthetic oligonucleotide
gacaggcgaacagggcgac

SEQ ID NO: 1520 - RNA, 19 nt, Artificial Sequence
  Description of Artificial Sequence: Synthetic oligonucleotide
gucgcccuguucgccuguc

SEQ ID NO: 1521 - RNA, 19 nt, Artificial Sequence
  Description of Artificial Sequence: Synthetic oligonucleotide
acaggcgaacagggcgaca

SEQ ID NO: 1522 - RNA, 19 nt, Artificial Sequence
  Description of Artificial Sequence: Synthetic oligonucleotide
ugucgcccuguucgccugu

SEQ ID NO: 1523 - RNA, 19 nt, Artificial Sequence
  Description of Artificial Sequence: Synthetic oligonucleotide
caggcgaacagggcgacag

SEQ ID NO: 1524 - RNA, 19 nt, Artificial Sequence
  Description of Artificial Sequence: Synthetic oligonucleotide
cugucgcccuguucgccug

SEQ ID NO: 1525 - RNA, 19 nt, Artificial Sequence
  Description of Artificial Sequence: Synthetic oligonucleotide
aggcgaacagggcgacaga

SEQ ID NO: 1526 - RNA, 19 nt, Artificial Sequence
  Description of Artificial Sequence: Synthetic oligonucleotide
ucugucgcccuguucgccu

SEQ ID NO: 1527 - RNA, 19 nt, Artificial Sequence
  Description of Artificial Sequence: Synthetic oligonucleotide
ggcgaacagggcgacagag

SEQ ID NO: 1528 - RNA, 19 nt, Artificial Sequence
  Description of Artificial Sequence: Synthetic oligonucleotide
cucugucgcccuguucgcc

SEQ ID NO: 1529 - RNA, 19 nt, Artificial Sequence
  Description of Artificial Sequence: Synthetic oligonucleotide
gcgaacagggcgacagagg

SEQ ID NO: 1530 - RNA, 19 nt, Artificial Sequence
  Description of Artificial Sequence: Synthetic oligonucleotide
ccucugucgcccuguucgc

SEQ ID NO: 1531 - RNA, 19 nt, Artificial Sequence
  Description of Artificial Sequence: Synthetic oligonucleotide
cgaacagggcgacagaggc

SEQ ID NO: 1532 - RNA, 19 nt, Artificial Sequence
  Description of Artificial Sequence: Synthetic oligonucleotide
gccucugucgcccuguucg

SEQ ID NO: 1533 - RNA, 19 nt, Artificial Sequence
  Description of Artificial Sequence: Synthetic oligonucleotide
acagggcgacagaggcaua

SEQ ID NO: 1534 - RNA, 19 nt, Artificial Sequence
  Description of Artificial Sequence: Synthetic oligonucleotide
uaugccucugucgcccugu

SEQ ID NO: 1535 - RNA, 19 nt, Artificial Sequence
  Description of Artificial Sequence: Synthetic oligonucleotide
cagggcgacagaggcauaa

SEQ ID NO: 1536 - RNA, 19 nt, Artificial Sequence
  Description of Artificial Sequence: Synthetic oligonucleotide
uuaugccucugucgcccug

SEQ ID NO: 1537 - RNA, 19 nt, Artificial Sequence
  Description of Artificial Sequence: Synthetic oligonucleotide
gcgacagaggcauaaaggg

SEQ ID NO: 1538 - RNA, 19 nt, Artificial Sequence
  Description of Artificial Sequence: Synthetic oligonucleotide
cccuuuaugccucugucgc

SEQ ID NO: 1539 - RNA, 19 nt, Artificial Sequence
  Description of Artificial Sequence: Synthetic oligonucleotide
cgacagaggcauaaagggu

SEQ ID NO: 1540 - RNA, 19 nt, Artificial Sequence
  Description of Artificial Sequence: Synthetic oligonucleotide
acccuuuaugccucugucg

SEQ ID NO: 1541 - RNA, 19 nt, Artificial Sequence
  Description of Artificial Sequence: Synthetic oligonucleotide
gacagaggcauaaaggguc

SEQ ID NO: 1542 - RNA, 19 nt, Artificial Sequence
  Description of Artificial Sequence: Synthetic oligonucleotide
gacccuuuaugccucuguc

SEQ ID NO: 1543 - RNA, 19 nt, Artificial Sequence
  Description of Artificial Sequence: Synthetic oligonucleotide
acagaggcauaaaggguca

SEQ ID NO: 1544 - RNA, 19 nt, Artificial Sequence
  Description of Artificial Sequence: Synthetic oligonucleotide
ugacccuuuaugccucugu

SEQ ID NO: 1545 - RNA, 19 nt, Artificial Sequence
  Description of Artificial Sequence: Synthetic oligonucleotide
cagaggcauaaagggucac

SEQ ID NO: 1546 - RNA, 19 nt, Artificial Sequence
  Description of Artificial Sequence: Synthetic oligonucleotide
gugacccuuuaugccucug

SEQ ID NO: 1547 - RNA, 19 nt, Artificial Sequence
  Description of Artificial Sequence: Synthetic oligonucleotide
aggcauaaagggucaccgu

SEQ ID NO: 1548 - RNA, 19 nt, Artificial Sequence
  Description of Artificial Sequence: Synthetic oligonucleotide
acggugacccuuuaugccu

SEQ ID NO: 1549 - RNA, 19 nt, Artificial Sequence
  Description of Artificial Sequence: Synthetic oligonucleotide
ggcauaaagggucaccgug

SEQ ID NO: 1550 - RNA, 19 nt, Artificial Sequence
  Description of Artificial Sequence: Synthetic oligonucleotide
cacggugacccuuuaugcc

SEQ ID NO: 1551 - RNA, 19 nt, Artificial Sequence
  Description of Artificial Sequence: Synthetic oligonucleotide
gcauaaagggucaccgugg

SEQ ID NO: 1552 - RNA, 19 nt, Artificial Sequence
  Description of Artificial Sequence: Synthetic oligonucleotide
ccacggugacccuuuaugc

SEQ ID NO: 1553 - RNA, 19 nt, Artificial Sequence
  Description of Artificial Sequence: Synthetic oligonucleotide
cauaaagggucaccguggc

SEQ ID NO: 1554 - RNA, 19 nt, Artificial Sequence
  Description of Artificial Sequence: Synthetic oligonucleotide
gccacggugacccuuuaug

SEQ ID NO: 1555 - RNA, 19 nt, Artificial Sequence
  Description of Artificial Sequence: Synthetic oligonucleotide
auaaagggucaccguggcu

SEQ ID NO: 1556 - RNA, 19 nt, Artificial Sequence
  Description of Artificial Sequence: Synthetic oligonucleotide
agccacggugacccuuuau

SEQ ID NO: 1557 - RNA, 19 nt, Artificial Sequence
  Description of Artificial Sequence: Synthetic oligonucleotide
agggucaccguggcuucuc

SEQ ID NO: 1558 - RNA, 19 nt, Artificial Sequence
  Description of Artificial Sequence: Synthetic oligonucleotide
gagaagccacggugacccu

SEQ ID NO: 1559 - RNA, 19 nt, Artificial Sequence
  Description of Artificial Sequence: Synthetic oligonucleotide
gggucaccguggcuucucu

SEQ ID NO: 1560 - RNA, 19 nt, Artificial Sequence
  Description of Artificial Sequence: Synthetic oligonucleotide
agagaagccacggugaccc

SEQ ID NO: 1561 - RNA, 19 nt, Artificial Sequence
  Description of Artificial Sequence: Synthetic oligonucleotide
ggucaccguggcuucucug

SEQ ID NO: 1562 - RNA, 19 nt, Artificial Sequence
  Description of Artificial Sequence: Synthetic oligonucleotide
cagagaagccacggugacc

SEQ ID NO: 1563 - RNA, 19 nt, Artificial Sequence
  Description of Artificial Sequence: Synthetic oligonucleotide
cuggugaacaaggucccuc

SEQ ID NO: 1564 - RNA, 19 nt, Artificial Sequence
  Description of Artificial Sequence: Synthetic oligonucleotide
gagggaccuuguucaccag

SEQ ID NO: 1565 - RNA, 19 nt, Artificial Sequence
  Description of Artificial Sequence: Synthetic oligonucleotide
uggugaacaaggucccucu

SEQ ID NO: 1566 - RNA, 19 nt, Artificial Sequence
  Description of Artificial Sequence: Synthetic oligonucleotide
agagggaccuuguucacca

SEQ ID NO: 1567 - RNA, 19 nt, Artificial Sequence
  Description of Artificial Sequence: Synthetic oligonucleotide
ugcugguccccgagguccc

SEQ ID NO: 1568 - RNA, 19 nt, Artificial Sequence
  Description of Artificial Sequence: Synthetic oligonucleotide
gggaccucggggaccagca

SEQ ID NO: 1569 - RNA, 19 nt, Artificial Sequence
  Description of Artificial Sequence: Synthetic oligonucleotide
aggucccccuggcucugcu

SEQ ID NO: 1570 - RNA, 19 nt, Artificial Sequence
  Description of Artificial Sequence: Synthetic oligonucleotide
agcagagccagggggaccu

SEQ ID NO: 1571 - RNA, 19 nt, Artificial Sequence
  Description of Artificial Sequence: Synthetic oligonucleotide
ggcaaagauggacucaacg

SEQ ID NO: 1572 - RNA, 19 nt, Artificial Sequence
  Description of Artificial Sequence: Synthetic oligonucleotide
cguugaguccaucuuugcc

SEQ ID NO: 1573 - RNA, 19 nt, Artificial Sequence
  Description of Artificial Sequence: Synthetic oligonucleotide
gcaaagauggacucaacgg

SEQ ID NO: 1574 - RNA, 19 nt, Artificial Sequence
  Description of Artificial Sequence: Synthetic oligonucleotide
ccguugaguccaucuuugc

SEQ ID NO: 1575 - RNA, 19 nt, Artificial Sequence
  Description of Artificial Sequence: Synthetic oligonucleotide
caaagauggacucaacggu

SEQ ID NO: 1576 - RNA, 19 nt, Artificial Sequence
  Description of Artificial Sequence: Synthetic oligonucleotide
accguugaguccaucuuug

SEQ ID NO: 1577 - RNA, 19 nt, Artificial Sequence
  Description of Artificial Sequence: Synthetic oligonucleotide
aaagauggacucaacgguc

SEQ ID NO: 1578 - RNA, 19 nt, Artificial Sequence
  Description of Artificial Sequence: Synthetic oligonucleotide
gaccguugaguccaucuuu

SEQ ID NO: 1579 - RNA, 19 nt, Artificial Sequence
  Description of Artificial Sequence: Synthetic oligonucleotide
aagauggacucaacggucu

SEQ ID NO: 1580 - RNA, 19 nt, Artificial Sequence
  Description of Artificial Sequence: Synthetic oligonucleotide
agaccguugaguccaucuu

SEQ ID NO: 1581 - RNA, 19 nt, Artificial Sequence
  Description of Artificial Sequence: Synthetic oligonucleotide
gauggacucaacggucucc

SEQ ID NO: 1582 - RNA, 19 nt, Artificial Sequence
  Description of Artificial Sequence: Synthetic oligonucleotide
ggagaccguugaguccauc

SEQ ID NO: 1583 - RNA, 19 nt, Artificial Sequence
  Description of Artificial Sequence: Synthetic oligonucleotide
auggacucaacggucuccc

SEQ ID NO: 1584 - RNA, 19 nt, Artificial Sequence
  Description of Artificial Sequence: Synthetic oligonucleotide
gggagaccguugaguccau

SEQ ID NO: 1585 - RNA, 19 nt, Artificial Sequence
  Description of Artificial Sequence: Synthetic oligonucleotide
uggacucaacggucucccu

SEQ ID NO: 1586 - RNA, 19 nt, Artificial Sequence
  Description of Artificial Sequence: Synthetic oligonucleotide
agggagaccguugagucca

SEQ ID NO: 1587 - RNA, 19 nt, Artificial Sequence
  Description of Artificial Sequence: Synthetic oligonucleotide
gacucaacggucucccugg

SEQ ID NO: 1588 - RNA, 19 nt, Artificial Sequence
  Description of Artificial Sequence: Synthetic oligonucleotide
ccagggagaccguugaguc

SEQ ID NO: 1589 - RNA, 19 nt, Artificial Sequence
  Description of Artificial Sequence: Synthetic oligonucleotide
gucucccuggccccauugg

SEQ ID NO: 1590 - RNA, 19 nt, Artificial Sequence
  Description of Artificial Sequence: Synthetic oligonucleotide
ccaauggggccagggagac

SEQ ID NO: 1591 - RNA, 19 nt, Artificial Sequence
  Description of Artificial Sequence: Synthetic oligonucleotide
cugguccucgcggucgcac

SEQ ID NO: 1592 - RNA, 19 nt, Artificial Sequence
  Description of Artificial Sequence: Synthetic oligonucleotide
gugcgaccgcgaggaccag

SEQ ID NO: 1593 - RNA, 19 nt, Artificial Sequence
  Description of Artificial Sequence: Synthetic oligonucleotide
ugguccucgcggucgcacu

SEQ ID NO: 1594 - RNA, 19 nt, Artificial Sequence
  Description of Artificial Sequence: Synthetic oligonucleotide
agugcgaccgcgaggacca

SEQ ID NO: 1595 - RNA, 19 nt, Artificial Sequence
  Description of Artificial Sequence: Synthetic oligonucleotide
gguccucgcggucgcacug

SEQ ID NO: 1596 - RNA, 19 nt, Artificial Sequence
  Description of Artificial Sequence: Synthetic oligonucleotide
cagugcgaccgcgaggacc

SEQ ID NO: 1597 - RNA, 19 nt, Artificial Sequence
  Description of Artificial Sequence: Synthetic oligonucleotide
guccucgcggucgcacugg

SEQ ID NO: 1598 - RNA, 19 nt, Artificial Sequence
  Description of Artificial Sequence: Synthetic oligonucleotide
ccagugcgaccgcgaggac

SEQ ID NO: 1599 - RNA, 19 nt, Artificial Sequence
  Description of Artificial Sequence: Synthetic oligonucleotide
ucgcggucgcacuggugau

SEQ ID NO: 1600 - RNA, 19 nt, Artificial Sequence
  Description of Artificial Sequence: Synthetic oligonucleotide
aucaccagugcgaccgcga

SEQ ID NO: 1601 - RNA, 19 nt, Artificial Sequence
  Description of Artificial Sequence: Synthetic oligonucleotide
cgcggucgcacuggugaug

SEQ ID NO: 1602 - RNA, 19 nt, Artificial Sequence
  Description of Artificial Sequence: Synthetic oligonucleotide
caucaccagugcgaccgcg

SEQ ID NO: 1603 - RNA, 19 nt, Artificial Sequence
  Description of Artificial Sequence: Synthetic oligonucleotide
gcggucgcacuggugaugc

SEQ ID NO: 1604 - RNA, 19 nt, Artificial Sequence
  Description of Artificial Sequence: Synthetic oligonucleotide
gcaucaccagugcgaccgc

SEQ ID NO: 1605 - RNA, 19 nt, Artificial Sequence
  Description of Artificial Sequence: Synthetic oligonucleotide
cggucgcacuggugaugcu

SEQ ID NO: 1606 - RNA, 19 nt, Artificial Sequence
  Description of Artificial Sequence: Synthetic oligonucleotide
agcaucaccagugcgaccg

SEQ ID NO: 1607 - RNA, 19 nt, Artificial Sequence
  Description of Artificial Sequence: Synthetic oligonucleotide
gcugguccuguuggucccc

SEQ ID NO: 1608 - RNA, 19 nt, Artificial Sequence
  Description of Artificial Sequence: Synthetic oligonucleotide
ggggaccaacaggaccagc

SEQ ID NO: 1609 - RNA, 19 nt, Artificial Sequence
  Description of Artificial Sequence: Synthetic oligonucleotide
guccucccagcgcugguuu

SEQ ID NO: 1610 - RNA, 19 nt, Artificial Sequence
  Description of Artificial Sequence: Synthetic oligonucleotide
aaaccagcgcugggaggac

SEQ ID NO: 1611 - RNA, 19 nt, Artificial Sequence
  Description of Artificial Sequence: Synthetic oligonucleotide
cucccagcgcugguuucga

SEQ ID NO: 1612 - RNA, 19 nt, Artificial Sequence
  Description of Artificial Sequence: Synthetic oligonucleotide
ucgaaaccagcgcugggag

SEQ ID NO: 1613 - RNA, 19 nt, Artificial Sequence
  Description of Artificial Sequence: Synthetic oligonucleotide
ucccagcgcugguuucgac

SEQ ID NO: 1614 - RNA, 19 nt, Artificial Sequence
  Description of Artificial Sequence: Synthetic oligonucleotide
gucgaaaccagcgcuggga

SEQ ID NO: 1615 - RNA, 19 nt, Artificial Sequence
  Description of Artificial Sequence: Synthetic oligonucleotide
ccagcgcugguuucgacuu

SEQ ID NO: 1616 - RNA, 19 nt, Artificial Sequence
  Description of Artificial Sequence: Synthetic oligonucleotide
aagucgaaaccagcgcugg

SEQ ID NO: 1617 - RNA, 19 nt, Artificial Sequence
  Description of Artificial Sequence: Synthetic oligonucleotide
cagcgcugguuucgacuuc

SEQ ID NO: 1618 - RNA, 19 nt, Artificial Sequence
  Description of Artificial Sequence: Synthetic oligonucleotide
gaagucgaaaccagcgcug

SEQ ID NO: 1619 - RNA, 19 nt, Artificial Sequence
  Description of Artificial Sequence: Synthetic oligonucleotide
agcgcugguuucgacuuca

SEQ ID NO: 1620 - RNA, 19 nt, Artificial Sequence
  Description of Artificial Sequence: Synthetic oligonucleotide
ugaagucgaaaccagcgcu

SEQ ID NO: 1621 - RNA, 19 nt, Artificial Sequence
  Description of Artificial Sequence: Synthetic oligonucleotide
gcugguuucgacuucagcu

SEQ ID NO: 1622 - RNA, 19 nt, Artificial Sequence
  Description of Artificial Sequence: Synthetic oligonucleotide
agcugaagucgaaaccagc

SEQ ID NO: 1623 - RNA, 19 nt, Artificial Sequence
  Description of Artificial Sequence: Synthetic oligonucleotide
ccaccucaagagaaggcuc

SEQ ID NO: 1624 - RNA, 19 nt, Artificial Sequence
  Description of Artificial Sequence: Synthetic oligonucleotide
gagccuucucuugaggugg

SEQ ID NO: 1625 - RNA, 19 nt, Artificial Sequence
  Description of Artificial Sequence: Synthetic oligonucleotide
cucaagagaaggcucacga

SEQ ID NO: 1626 - RNA, 19 nt, Artificial Sequence
  Description of Artificial Sequence: Synthetic oligonucleotide
ucgugagccuucucuugag

SEQ ID NO: 1627 - RNA, 19 nt, Artificial Sequence
  Description of Artificial Sequence: Synthetic oligonucleotide
ucaagagaaggcucacgau

SEQ ID NO: 1628 - RNA, 19 nt, Artificial Sequence
  Description of Artificial Sequence: Synthetic oligonucleotide
aucgugagccuucucuuga

SEQ ID NO: 1629 - RNA, 19 nt, Artificial Sequence
  Description of Artificial Sequence: Synthetic oligonucleotide
caagagaaggcucacgaug

SEQ ID NO: 1630 - RNA, 19 nt, Artificial Sequence
  Description of Artificial Sequence: Synthetic oligonucleotide
caucgugagccuucucuug

SEQ ID NO: 1631 - RNA, 19 nt, Artificial Sequence
  Description of Artificial Sequence: Synthetic oligonucleotide
aagagaaggcucacgaugg

SEQ ID NO: 1632 - RNA, 19 nt, Artificial Sequence
  Description of Artificial Sequence: Synthetic oligonucleotide
ccaucgugagccuucucuu

SEQ ID NO: 1633 - RNA, 19 nt, Artificial Sequence
  Description of Artificial Sequence: Synthetic oligonucleotide
agagaaggcucacgauggu

SEQ ID NO: 1634 - RNA, 19 nt, Artificial Sequence
  Description of Artificial Sequence: Synthetic oligonucleotide
accaucgugagccuucucu

SEQ ID NO: 1635 - RNA, 19 nt, Artificial Sequence
  Description of Artificial Sequence: Synthetic oligonucleotide
gagaaggcucacgauggug

SEQ ID NO: 1636 - RNA, 19 nt, Artificial Sequence
  Description of Artificial Sequence: Synthetic oligonucleotide
caccaucgugagccuucuc

SEQ ID NO: 1637 - RNA, 19 nt, Artificial Sequence
  Description of Artificial Sequence: Synthetic oligonucleotide
aaggcucacgaugguggcc

SEQ ID NO: 1638 - RNA, 19 nt, Artificial Sequence
  Description of Artificial Sequence: Synthetic oligonucleotide
ggccaccaucgugagccuu

SEQ ID NO: 1639 - RNA, 19 nt, Artificial Sequence
  Description of Artificial Sequence: Synthetic oligonucleotide
ggcucacgaugguggccgc

SEQ ID NO: 1640 - RNA, 19 nt, Artificial Sequence
  Description of Artificial Sequence: Synthetic oligonucleotide
gcggccaccaucgugagcc

SEQ ID NO: 1641 - RNA, 19 nt, Artificial Sequence
  Description of Artificial Sequence: Synthetic oligonucleotide
cucacgaugguggccgcua

SEQ ID NO: 1642 - RNA, 19 nt, Artificial Sequence
  Description of Artificial Sequence: Synthetic oligonucleotide
uagcggccaccaucgugag

SEQ ID NO: 1643 - RNA, 19 nt, Artificial Sequence
  Description of Artificial Sequence: Synthetic oligonucleotide
acgaugguggccgcuacua

SEQ ID NO: 1644 - RNA, 19 nt, Artificial Sequence
  Description of Artificial Sequence: Synthetic oligonucleotide
uaguagcggccaccaucgu

SEQ ID NO: 1645 - RNA, 19 nt, Artificial Sequence
  Description of Artificial Sequence: Synthetic oligonucleotide
gguggccgcuacuaccggg

SEQ ID NO: 1646 - RNA, 19 nt, Artificial Sequence
  Description of Artificial Sequence: Synthetic oligonucleotide
cccgguaguagcggccacc

SEQ ID NO: 1647 - RNA, 19 nt, Artificial Sequence
  Description of Artificial Sequence: Synthetic oligonucleotide
guggccgcuacuaccgggc

SEQ ID NO: 1648 - RNA, 19 nt, Artificial Sequence
  Description of Artificial Sequence: Synthetic oligonucleotide
gcccgguaguagcggccac

SEQ ID NO: 1649 - RNA, 19 nt, Artificial Sequence
  Description of Artificial Sequence: Synthetic oligonucleotide
uggccgcuacuaccgggcu

SEQ ID NO: 1650 - RNA, 19 nt, Artificial Sequence
  Description of Artificial Sequence: Synthetic oligonucleotide
agcccgguaguagcggcca

SEQ ID NO: 1651 - RNA, 19 nt, Artificial Sequence
  Description of Artificial Sequence: Synthetic oligonucleotide
cuacuaccgggcugaugau

SEQ ID NO: 1652 - RNA, 19 nt, Artificial Sequence
  Description of Artificial Sequence: Synthetic oligonucleotide
aucaucagcccgguaguag

SEQ ID NO: 1653 - RNA, 19 nt, Artificial Sequence
  Description of Artificial Sequence: Synthetic oligonucleotide
uacuaccgggcugaugaug

SEQ ID NO: 1654 - RNA, 19 nt, Artificial Sequence
  Description of Artificial Sequence: Synthetic oligonucleotide
caucaucagcccgguagua

SEQ ID NO: 1655 - RNA, 19 nt, Artificial Sequence
  Description of Artificial Sequence: Synthetic oligonucleotide
cuaccgggcugaugaugcc

SEQ ID NO: 1656 - RNA, 19 nt, Artificial Sequence
  Description of Artificial Sequence: Synthetic oligonucleotide
ggcaucaucagcccgguag

SEQ ID NO: 1657 - RNA, 19 nt, Artificial Sequence
  Description of Artificial Sequence: Synthetic oligonucleotide
uaccgggcugaugaugcca

SEQ ID NO: 1658 - RNA, 19 nt, Artificial Sequence
  Description of Artificial Sequence: Synthetic oligonucleotide
uggcaucaucagcccggua

SEQ ID NO: 1659 - RNA, 19 nt, Artificial Sequence
  Description of Artificial Sequence: Synthetic oligonucleotide
accgggcugaugaugccaa

SEQ ID NO: 1660 - RNA, 19 nt, Artificial Sequence
  Description of Artificial Sequence: Synthetic oligonucleotide
uuggcaucaucagcccggu

SEQ ID NO: 1661 - RNA, 19 nt, Artificial Sequence
  Description of Artificial Sequence: Synthetic oligonucleotide
augaugccaaugugguucg

SEQ ID NO: 1662 - RNA, 19 nt, Artificial Sequence
  Description of Artificial Sequence: Synthetic oligonucleotide
cgaaccacauuggcaucau

SEQ ID NO: 1663 - RNA, 19 nt, Artificial Sequence
  Description of Artificial Sequence: Synthetic oligonucleotide
ugaugccaaugugguucgu

SEQ ID NO: 1664 - RNA, 19 nt, Artificial Sequence
  Description of Artificial Sequence: Synthetic oligonucleotide
acgaaccacauuggcauca

SEQ ID NO: 1665 - RNA, 19 nt, Artificial Sequence
  Description of Artificial Sequence: Synthetic oligonucleotide
gaugccaaugugguucgug

SEQ ID NO: 1666 - RNA, 19 nt, Artificial Sequence
  Description of Artificial Sequence: Synthetic oligonucleotide
cacgaaccacauuggcauc

SEQ ID NO: 1667 - RNA, 19 nt, Artificial Sequence
  Description of Artificial Sequence: Synthetic oligonucleotide
gccaaugugguucgugacc

SEQ ID NO: 1668 - RNA, 19 nt, Artificial Sequence
  Description of Artificial Sequence: Synthetic oligonucleotide
ggucacgaaccacauuggc

SEQ ID NO: 1669 - RNA, 19 nt, Artificial Sequence
  Description of Artificial Sequence: Synthetic oligonucleotide
ccaaugugguucgugaccg

SEQ ID NO: 1670 - RNA, 19 nt, Artificial Sequence
  Description of Artificial Sequence: Synthetic oligonucleotide
cggucacgaaccacauugg

SEQ ID NO: 1671 - RNA, 19 nt, Artificial Sequence
  Description of Artificial Sequence: Synthetic oligonucleotide
caaugugguucgugaccgu

SEQ ID NO: 1672 - RNA, 19 nt, Artificial Sequence
  Description of Artificial Sequence: Synthetic oligonucleotide
acggucacgaaccacauug

SEQ ID NO: 1673 - RNA, 19 nt, Artificial Sequence
  Description of Artificial Sequence: Synthetic oligonucleotide
aaugugguucgugaccgug

SEQ ID NO: 1674 - RNA, 19 nt, Artificial Sequence
  Description of Artificial Sequence: Synthetic oligonucleotide
cacggucacgaaccacauu

SEQ ID NO: 1675 - RNA, 19 nt, Artificial Sequence
  Description of Artificial Sequence: Synthetic oligonucleotide
augugguucgugaccguga

SEQ ID NO: 1676 - RNA, 19 nt, Artificial Sequence
  Description of Artificial Sequence: Synthetic oligonucleotide
ucacggucacgaaccacau

SEQ ID NO: 1677 - RNA, 19 nt, Artificial Sequence
  Description of Artificial Sequence: Synthetic oligonucleotide
ugugguucgugaccgugac

SEQ ID NO: 1678 - RNA, 19 nt, Artificial Sequence
  Description of Artificial Sequence: Synthetic oligonucleotide
gucacggucacgaaccaca

SEQ ID NO: 1679 - RNA, 19 nt, Artificial Sequence
  Description of Artificial Sequence: Synthetic oligonucleotide
gugguucgugaccgugacc

SEQ ID NO: 1680 - RNA, 19 nt, Artificial Sequence
  Description of Artificial Sequence: Synthetic oligonucleotide
ggucacggucacgaaccac

SEQ ID NO: 1681 - RNA, 19 nt, Artificial Sequence
  Description of Artificial Sequence: Synthetic oligonucleotide
gguucgugaccgugaccuc

SEQ ID NO: 1682 - RNA, 19 nt, Artificial Sequence
  Description of Artificial Sequence: Synthetic oligonucleotide
gaggucacggucacgaacc

SEQ ID NO: 1683 - RNA, 19 nt, Artificial Sequence
  Description of Artificial Sequence: Synthetic oligonucleotide
guucgugaccgugaccucg

SEQ ID NO: 1684 - RNA, 19 nt, Artificial Sequence
  Description of Artificial Sequence: Synthetic oligonucleotide
cgaggucacggucacgaac

SEQ ID NO: 1685 - RNA, 19 nt, Artificial Sequence
  Description of Artificial Sequence: Synthetic oligonucleotide
uucgugaccgugaccucga

SEQ ID NO: 1686 - RNA, 19 nt, Artificial Sequence
  Description of Artificial Sequence: Synthetic oligonucleotide
ucgaggucacggucacgaa

SEQ ID NO: 1687 - RNA, 19 nt, Artificial Sequence
  Description of Artificial Sequence: Synthetic oligonucleotide
cgugaccgugaccucgagg

SEQ ID NO: 1688 - RNA, 19 nt, Artificial Sequence
  Description of Artificial Sequence: Synthetic oligonucleotide
ccucgaggucacggucacg

SEQ ID NO: 1689 - RNA, 19 nt, Artificial Sequence
  Description of Artificial Sequence: Synthetic oligonucleotide
ugaccgugaccucgaggug

SEQ ID NO: 1690 - RNA, 19 nt, Artificial Sequence
  Description of Artificial Sequence: Synthetic oligonucleotide
caccucgaggucacgguca

SEQ ID NO: 1691 - RNA, 19 nt, Artificial Sequence
  Description of Artificial Sequence: Synthetic oligonucleotide
accgugaccucgaggugga

SEQ ID NO: 1692 - RNA, 19 nt, Artificial Sequence
  Description of Artificial Sequence: Synthetic oligonucleotide
uccaccucgaggucacggu

SEQ ID NO: 1693 - RNA, 19 nt, Artificial Sequence
  Description of Artificial Sequence: Synthetic oligonucleotide
cgugaccucgagguggaca

SEQ ID NO: 1694 - RNA, 19 nt, Artificial Sequence
  Description of Artificial Sequence: Synthetic oligonucleotide
uguccaccucgaggucacg

SEQ ID NO: 1695 - RNA, 19 nt, Artificial Sequence
  Description of Artificial Sequence: Synthetic oligonucleotide
cucgagguggacaccaccc

SEQ ID NO: 1696 - RNA, 19 nt, Artificial Sequence
  Description of Artificial Sequence: Synthetic oligonucleotide
gggugguguccaccucgag

SEQ ID NO: 1697 - RNA, 19 nt, Artificial Sequence
  Description of Artificial Sequence: Synthetic oligonucleotide
gcagaucgagaacauccgg

SEQ ID NO: 1698 - RNA, 19 nt, Artificial Sequence
  Description of Artificial Sequence: Synthetic oligonucleotide
ccggauguucucgaucugc

SEQ ID NO: 1699 - RNA, 19 nt, Artificial Sequence
  Description of Artificial Sequence: Synthetic oligonucleotide
cagaucgagaacauccgga

SEQ ID NO: 1700 - RNA, 19 nt, Artificial Sequence
  Description of Artificial Sequence: Synthetic oligonucleotide
uccggauguucucgaucug

SEQ ID NO: 1701 - RNA, 19 nt, Artificial Sequence
  Description of Artificial Sequence: Synthetic oligonucleotide
gaucgagaacauccggagc

SEQ ID NO: 1702 - RNA, 19 nt, Artificial Sequence
  Description of Artificial Sequence: Synthetic oligonucleotide
gcuccggauguucucgauc

SEQ ID NO: 1703 - RNA, 19 nt, Artificial Sequence
  Description of Artificial Sequence: Synthetic oligonucleotide
cgagaacauccggagccca

SEQ ID NO: 1704 - RNA, 19 nt, Artificial Sequence
  Description of Artificial Sequence: Synthetic oligonucleotide
ugggcuccggauguucucg

SEQ ID NO: 1705 - RNA, 19 nt, Artificial Sequence
  Description of Artificial Sequence: Synthetic oligonucleotide
gagaacauccggagcccag

SEQ ID NO: 1706 - RNA, 19 nt, Artificial Sequence
  Description of Artificial Sequence: Synthetic oligonucleotide
cugggcuccggauguucuc

SEQ ID NO: 1707 - RNA, 19 nt, Artificial Sequence
  Description of Artificial Sequence: Synthetic oligonucleotide
gaacauccggagcccagag

SEQ ID NO: 1708 - RNA, 19 nt, Artificial Sequence
  Description of Artificial Sequence: Synthetic oligonucleotide
cucugggcuccggauguuc

SEQ ID NO: 1709 - RNA, 19 nt, Artificial Sequence
  Description of Artificial Sequence: Synthetic oligonucleotide
cgcccgcaccugccgugac

SEQ ID NO: 1710 - RNA, 19 nt, Artificial Sequence
  Description of Artificial Sequence: Synthetic oligonucleotide
gucacggcaggugcgggcg

SEQ ID NO: 1711 - RNA, 19 nt, Artificial Sequence
  Description of Artificial Sequence: Synthetic oligonucleotide
cccgcaccugccgugaccu

SEQ ID NO: 1712 - RNA, 19 nt, Artificial Sequence
  Description of Artificial Sequence: Synthetic oligonucleotide
aggucacggcaggugcggg

SEQ ID NO: 1713 - RNA, 19 nt, Artificial Sequence
  Description of Artificial Sequence: Synthetic oligonucleotide
ccgcaccugccgugaccuc

SEQ ID NO: 1714 - RNA, 19 nt, Artificial Sequence
  Description of Artificial Sequence: Synthetic oligonucleotide
gaggucacggcaggugcgg

SEQ ID NO: 1715 - RNA, 19 nt, Artificial Sequence
  Description of Artificial Sequence: Synthetic oligonucleotide
cgcaccugccgugaccuca

SEQ ID NO: 1716 - RNA, 19 nt, Artificial Sequence
  Description of Artificial Sequence: Synthetic oligonucleotide
ugaggucacggcaggugcg

SEQ ID NO: 1717 - RNA, 19 nt, Artificial Sequence
  Description of Artificial Sequence: Synthetic oligonucleotide
ugccgugaccucaagaugu

SEQ ID NO: 1718 - RNA, 19 nt, Artificial Sequence
  Description of Artificial Sequence: Synthetic oligonucleotide
acaucuugaggucacggca

SEQ ID NO: 1719 - RNA, 19 nt, Artificial Sequence
  Description of Artificial Sequence: Synthetic oligonucleotide
gccgugaccucaagaugug

SEQ ID NO: 1720 - RNA, 19 nt, Artificial Sequence
  Description of Artificial Sequence: Synthetic oligonucleotide
cacaucuugaggucacggc

SEQ ID NO: 1721 - RNA, 19 nt, Artificial Sequence
  Description of Artificial Sequence: Synthetic oligonucleotide
ugaccucaagaugugccac

SEQ ID NO: 1722 - RNA, 19 nt, Artificial Sequence
  Description of Artificial Sequence: Synthetic oligonucleotide
guggcacaucuugagguca

SEQ ID NO: 1723 - RNA, 19 nt, Artificial Sequence
  Description of Artificial Sequence: Synthetic oligonucleotide
accucaagaugugccacuc

SEQ ID NO: 1724 - RNA, 19 nt, Artificial Sequence
  Description of Artificial Sequence: Synthetic oligonucleotide
gaguggcacaucuugaggu

SEQ ID NO: 1725 - RNA, 19 nt, Artificial Sequence
  Description of Artificial Sequence: Synthetic oligonucleotide
ccucaagaugugccacucu

SEQ ID NO: 1726 - RNA, 19 nt, Artificial Sequence
  Description of Artificial Sequence: Synthetic oligonucleotide
agaguggcacaucuugagg

SEQ ID NO: 1727 - RNA, 19 nt, Artificial Sequence
  Description of Artificial Sequence: Synthetic oligonucleotide
cucaagaugugccacucug

SEQ ID NO: 1728 - RNA, 19 nt, Artificial Sequence
  Description of Artificial Sequence: Synthetic oligonucleotide
cagaguggcacaucuugag

SEQ ID NO: 1729 - RNA, 19 nt, Artificial Sequence
  Description of Artificial Sequence: Synthetic oligonucleotide
ucaagaugugccacucuga

SEQ ID NO: 1730 - RNA, 19 nt, Artificial Sequence
  Description of Artificial Sequence: Synthetic oligonucleotide
ucagaguggcacaucuuga

SEQ ID NO: 1731 - RNA, 19 nt, Artificial Sequence
  Description of Artificial Sequence: Synthetic oligonucleotide
cccaaccaaggcugcaacc

SEQ ID NO: 1732 - RNA, 19 nt, Artificial Sequence
  Description of Artificial Sequence: Synthetic oligonucleotide
gguugcagccuugguuggg

SEQ ID NO: 1733 - RNA, 19 nt, Artificial Sequence
  Description of Artificial Sequence: Synthetic oligonucleotide
caaccaaggcugcaaccug

SEQ ID NO: 1734 - RNA, 19 nt, Artificial Sequence
  Description of Artificial Sequence: Synthetic oligonucleotide
cagguugcagccuugguug

SEQ ID NO: 1735 - RNA, 19 nt, Artificial Sequence
  Description of Artificial Sequence: Synthetic oligonucleotide
accaaggcugcaaccugga

SEQ ID NO: 1736 - RNA, 19 nt, Artificial Sequence
  Description of Artificial Sequence: Synthetic oligonucleotide
uccagguugcagccuuggu

SEQ ID NO: 1737 - RNA, 19 nt, Artificial Sequence
  Description of Artificial Sequence: Synthetic oligonucleotide
gcugcaaccuggaugccau

SEQ ID NO: 1738 - RNA, 19 nt, Artificial Sequence
  Description of Artificial Sequence: Synthetic oligonucleotide
auggcauccagguugcagc

SEQ ID NO: 1739 - RNA, 19 nt, Artificial Sequence
  Description of Artificial Sequence: Synthetic oligonucleotide
cugcaaccuggaugccauc

SEQ ID NO: 1740 - RNA, 19 nt, Artificial Sequence
  Description of Artificial Sequence: Synthetic oligonucleotide
gauggcauccagguugcag

SEQ ID NO: 1741 - RNA, 19 nt, Artificial Sequence
  Description of Artificial Sequence: Synthetic oligonucleotide
ccuggaugccaucaaaguc

SEQ ID NO: 1742 - RNA, 19 nt, Artificial Sequence
  Description of Artificial Sequence: Synthetic oligonucleotide
gacuuugauggcauccagg

SEQ ID NO: 1743 - RNA, 19 nt, Artificial Sequence
  Description of Artificial Sequence: Synthetic oligonucleotide
cuggaugccaucaaagucu

SEQ ID NO: 1744 - RNA, 19 nt, Artificial Sequence
  Description of Artificial Sequence: Synthetic oligonucleotide
agacuuugauggcauccag

SEQ ID NO: 1745 - RNA, 19 nt, Artificial Sequence
  Description of Artificial Sequence: Synthetic oligonucleotide
uggaugccaucaaagucuu

SEQ ID NO: 1746 - RNA, 19 nt, Artificial Sequence
  Description of Artificial Sequence: Synthetic oligonucleotide
aagacuuugauggcaucca

SEQ ID NO: 1747 - RNA, 19 nt, Artificial Sequence
  Description of Artificial Sequence: Synthetic oligonucleotide
ggaugccaucaaagucuuc

SEQ ID NO: 1748 - RNA, 19 nt, Artificial Sequence
  Description of Artificial Sequence: Synthetic oligonucleotide
gaagacuuugauggcaucc

SEQ ID NO: 1749 - RNA, 19 nt, Artificial Sequence
  Description of Artificial Sequence: Synthetic oligonucleotide
gaugccaucaaagucuucu

SEQ ID NO: 1750 - RNA, 19 nt, Artificial Sequence
  Description of Artificial Sequence: Synthetic oligonucleotide
agaagacuuugauggcauc

SEQ ID NO: 1751 - RNA, 19 nt, Artificial Sequence
  Description of Artificial Sequence: Synthetic oligonucleotide
ugccaucaaagucuucugc

SEQ ID NO: 1752 - RNA, 19 nt, Artificial Sequence
  Description of Artificial Sequence: Synthetic oligonucleotide
gcagaagacuuugauggca

SEQ ID NO: 1753 - RNA, 19 nt, Artificial Sequence
  Description of Artificial Sequence: Synthetic oligonucleotide
caucaaagucuucugcaac

SEQ ID NO: 1754 - RNA, 19 nt, Artificial Sequence
  Description of Artificial Sequence: Synthetic oligonucleotide
guugcagaagacuuugaug

SEQ ID NO: 1755 - RNA, 19 nt, Artificial Sequence
  Description of Artificial Sequence: Synthetic oligonucleotide
aucaaagucuucugcaaca

SEQ ID NO: 1756 - RNA, 19 nt, Artificial Sequence
  Description of Artificial Sequence: Synthetic oligonucleotide
uguugcagaagacuuugau

SEQ ID NO: 1757 - RNA, 19 nt, Artificial Sequence
  Description of Artificial Sequence: Synthetic oligonucleotide
gcaacauggagacugguga

SEQ ID NO: 1758 - RNA, 19 nt, Artificial Sequence
  Description of Artificial Sequence: Synthetic oligonucleotide
ucaccagucuccauguugc

SEQ ID NO: 1759 - RNA, 19 nt, Artificial Sequence
  Description of Artificial Sequence: Synthetic oligonucleotide
auggagacuggugagaccu

SEQ ID NO: 1760 - RNA, 19 nt, Artificial Sequence
  Description of Artificial Sequence: Synthetic oligonucleotide
aggucucaccagucuccau

SEQ ID NO: 1761 - RNA, 19 nt, Artificial Sequence
  Description of Artificial Sequence: Synthetic oligonucleotide
acuggugagaccugcgugu

SEQ ID NO: 1762 - RNA, 19 nt, Artificial Sequence
  Description of Artificial Sequence: Synthetic oligonucleotide
acacgcaggucucaccagu

SEQ ID NO: 1763 - RNA, 19 nt, Artificial Sequence
  Description of Artificial Sequence: Synthetic oligonucleotide
cuggugagaccugcgugua

SEQ ID NO: 1764 - RNA, 19 nt, Artificial Sequence
  Description of Artificial Sequence: Synthetic oligonucleotide
uacacgcaggucucaccag

SEQ ID NO: 1765 - RNA, 19 nt, Artificial Sequence
  Description of Artificial Sequence: Synthetic oligonucleotide
uggugagaccugcguguac

SEQ ID NO: 1766 - RNA, 19 nt, Artificial Sequence
  Description of Artificial Sequence: Synthetic oligonucleotide
guacacgcaggucucacca

SEQ ID NO: 1767 - RNA, 19 nt, Artificial Sequence
  Description of Artificial Sequence: Synthetic oligonucleotide
ggugagaccugcguguacc

SEQ ID NO: 1768 - RNA, 19 nt, Artificial Sequence
  Description of Artificial Sequence: Synthetic oligonucleotide
gguacacgcaggucucacc

SEQ ID NO: 1769 - RNA, 19 nt, Artificial Sequence
  Description of Artificial Sequence: Synthetic oligonucleotide
gaccugcguguaccccacu

SEQ ID NO: 1770 - RNA, 19 nt, Artificial Sequence
  Description of Artificial Sequence: Synthetic oligonucleotide
agugggguacacgcagguc

SEQ ID NO: 1771 - RNA, 19 nt, Artificial Sequence
  Description of Artificial Sequence: Synthetic oligonucleotide
cugcguguaccccacucag

SEQ ID NO: 1772 - RNA, 19 nt, Artificial Sequence
  Description of Artificial Sequence: Synthetic oligonucleotide
cugagugggguacacgcag

SEQ ID NO: 1773 - RNA, 19 nt, Artificial Sequence
  Description of Artificial Sequence: Synthetic oligonucleotide
ugcguguaccccacucagc

SEQ ID NO: 1774 - RNA, 19 nt, Artificial Sequence
  Description of Artificial Sequence: Synthetic oligonucleotide
gcugagugggguacacgca

SEQ ID NO: 1775 - RNA, 19 nt, Artificial Sequence
  Description of Artificial Sequence: Synthetic oligonucleotide
gcguguaccccacucagcc

SEQ ID NO: 1776 - RNA, 19 nt, Artificial Sequence
  Description of Artificial Sequence: Synthetic oligonucleotide
ggcugagugggguacacgc

SEQ ID NO: 1777 - RNA, 19 nt, Artificial Sequence
  Description of Artificial Sequence: Synthetic oligonucleotide
cguguaccccacucagccc

SEQ ID NO: 1778 - RNA, 19 nt, Artificial Sequence
  Description of Artificial Sequence: Synthetic oligonucleotide
gggcugagugggguacacg

SEQ ID NO: 1779 - RNA, 19 nt, Artificial Sequence
  Description of Artificial Sequence: Synthetic oligonucleotide
guguaccccacucagccca

SEQ ID NO: 1780 - RNA, 19 nt, Artificial Sequence
  Description of Artificial Sequence: Synthetic oligonucleotide
ugggcugagugggguacac

SEQ ID NO: 1781 - RNA, 19 nt, Artificial Sequence
  Description of Artificial Sequence: Synthetic oligonucleotide
agcccaguguggcccagaa

SEQ ID NO: 1782 - RNA, 19 nt, Artificial Sequence
  Description of Artificial Sequence: Synthetic oligonucleotide
uucugggccacacugggcu

SEQ ID NO: 1783 - RNA, 19 nt, Artificial Sequence
  Description of Artificial Sequence: Synthetic oligonucleotide
gaagaacugguacaucagc

SEQ ID NO: 1784 - RNA, 19 nt, Artificial Sequence
  Description of Artificial Sequence: Synthetic oligonucleotide
gcugauguaccaguucuuc

SEQ ID NO: 1785 - RNA, 19 nt, Artificial Sequence
  Description of Artificial Sequence: Synthetic oligonucleotide
ccccaaggacaagaggcau

SEQ ID NO: 1786 - RNA, 19 nt, Artificial Sequence
  Description of Artificial Sequence: Synthetic oligonucleotide
augccucuuguccuugggg

SEQ ID NO: 1787 - RNA, 19 nt, Artificial Sequence
  Description of Artificial Sequence: Synthetic oligonucleotide
ccaaggacaagaggcaugu

SEQ ID NO: 1788 - RNA, 19 nt, Artificial Sequence
  Description of Artificial Sequence: Synthetic oligonucleotide
acaugccucuuguccuugg

SEQ ID NO: 1789 - RNA, 19 nt, Artificial Sequence
  Description of Artificial Sequence: Synthetic oligonucleotide
caaggacaagaggcauguc

SEQ ID NO: 1790 - RNA, 19 nt, Artificial Sequence
  Description of Artificial Sequence: Synthetic oligonucleotide
gacaugccucuuguccuug

SEQ ID NO: 1791 - RNA, 19 nt, Artificial Sequence
  Description of Artificial Sequence: Synthetic oligonucleotide
gacaagaggcaugucuggu

SEQ ID NO: 1792 - RNA, 19 nt, Artificial Sequence
  Description of Artificial Sequence: Synthetic oligonucleotide
accagacaugccucuuguc

SEQ ID NO: 1793 - RNA, 19 nt, Artificial Sequence
  Description of Artificial Sequence: Synthetic oligonucleotide
aagaggcaugucugguucg

SEQ ID NO: 1794 - RNA, 19 nt, Artificial Sequence
  Description of Artificial Sequence: Synthetic oligonucleotide
cgaaccagacaugccucuu

SEQ ID NO: 1795 - RNA, 19 nt, Artificial Sequence
  Description of Artificial Sequence: Synthetic oligonucleotide
agaggcaugucugguucgg

SEQ ID NO: 1796 - RNA, 19 nt, Artificial Sequence
  Description of Artificial Sequence: Synthetic oligonucleotide
ccgaaccagacaugccucu

SEQ ID NO: 1797 - RNA, 19 nt, Artificial Sequence
  Description of Artificial Sequence: Synthetic oligonucleotide
gaggcaugucugguucggc

SEQ ID NO: 1798 - RNA, 19 nt, Artificial Sequence
  Description of Artificial Sequence: Synthetic oligonucleotide
gccgaaccagacaugccuc

SEQ ID NO: 1799 - RNA, 19 nt, Artificial Sequence
  Description of Artificial Sequence: Synthetic oligonucleotide
aggcaugucugguucggcg

SEQ ID NO: 1800 - RNA, 19 nt, Artificial Sequence
  Description of Artificial Sequence: Synthetic oligonucleotide
cgccgaaccagacaugccu

SEQ ID NO: 1801 - RNA, 19 nt, Artificial Sequence
  Description of Artificial Sequence: Synthetic oligonucleotide
ggcaugucugguucggcga

SEQ ID NO: 1802 - RNA, 19 nt, Artificial Sequence
  Description of Artificial Sequence: Synthetic oligonucleotide
ucgccgaaccagacaugcc

SEQ ID NO: 1803 - RNA, 19 nt, Artificial Sequence
  Description of Artificial Sequence: Synthetic oligonucleotide
ugucugguucggcgagagc

SEQ ID NO: 1804 - RNA, 19 nt, Artificial Sequence
  Description of Artificial Sequence: Synthetic oligonucleotide
gcucucgccgaaccagaca

SEQ ID NO: 1805 - RNA, 19 nt, Artificial Sequence
  Description of Artificial Sequence: Synthetic oligonucleotide
gucugguucggcgagagca

SEQ ID NO: 1806 - RNA, 19 nt, Artificial Sequence
  Description of Artificial Sequence: Synthetic oligonucleotide
ugcucucgccgaaccagac

SEQ ID NO: 1807 - RNA, 19 nt, Artificial Sequence
  Description of Artificial Sequence: Synthetic oligonucleotide
ucugguucggcgagagcau

SEQ ID NO: 1808 - RNA, 19 nt, Artificial Sequence
  Description of Artificial Sequence: Synthetic oligonucleotide
augcucucgccgaaccaga

SEQ ID NO: 1809 - RNA, 19 nt, Artificial Sequence
  Description of Artificial Sequence: Synthetic oligonucleotide
cugguucggcgagagcaug

SEQ ID NO: 1810 - RNA, 19 nt, Artificial Sequence
  Description of Artificial Sequence: Synthetic oligonucleotide
caugcucucgccgaaccag

SEQ ID NO: 1811 - RNA, 19 nt, Artificial Sequence
  Description of Artificial Sequence: Synthetic oligonucleotide
ugguucggcgagagcauga

SEQ ID NO: 1812 - RNA, 19 nt, Artificial Sequence
  Description of Artificial Sequence: Synthetic oligonucleotide
ucaugcucucgccgaacca

SEQ ID NO: 1813 - RNA, 19 nt, Artificial Sequence
  Description of Artificial Sequence: Synthetic oligonucleotide
gguucggcgagagcaugac

SEQ ID NO: 1814 - RNA, 19 nt, Artificial Sequence
  Description of Artificial Sequence: Synthetic oligonucleotide
gucaugcucucgccgaacc

SEQ ID NO: 1815 - RNA, 19 nt, Artificial Sequence
  Description of Artificial Sequence: Synthetic oligonucleotide
guucggcgagagcaugacc

SEQ ID NO: 1816 - RNA, 19 nt, Artificial Sequence
  Description of Artificial Sequence: Synthetic oligonucleotide
ggucaugcucucgccgaac

SEQ ID NO: 1817 - RNA, 19 nt, Artificial Sequence
  Description of Artificial Sequence: Synthetic oligonucleotide
uucggcgagagcaugaccg

SEQ ID NO: 1818 - RNA, 19 nt, Artificial Sequence
  Description of Artificial Sequence: Synthetic oligonucleotide
cggucaugcucucgccgaa

SEQ ID NO: 1819 - RNA, 19 nt, Artificial Sequence
  Description of Artificial Sequence: Synthetic oligonucleotide
ucggcgagagcaugaccga

SEQ ID NO: 1820 - RNA, 19 nt, Artificial Sequence
  Description of Artificial Sequence: Synthetic oligonucleotide
ucggucaugcucucgccga

SEQ ID NO: 1821 - RNA, 19 nt, Artificial Sequence
  Description of Artificial Sequence: Synthetic oligonucleotide
cggcgagagcaugaccgau

SEQ ID NO: 1822 - RNA, 19 nt, Artificial Sequence
  Description of Artificial Sequence: Synthetic oligonucleotide
aucggucaugcucucgccg

SEQ ID NO: 1823 - RNA, 19 nt, Artificial Sequence
  Description of Artificial Sequence: Synthetic oligonucleotide
gcgagagcaugaccgaugg

SEQ ID NO: 1824 - RNA, 19 nt, Artificial Sequence
  Description of Artificial Sequence: Synthetic oligonucleotide
ccaucggucaugcucucgc

SEQ ID NO: 1825 - RNA, 19 nt, Artificial Sequence
  Description of Artificial Sequence: Synthetic oligonucleotide
cgagagcaugaccgaugga

SEQ ID NO: 1826 - RNA, 19 nt, Artificial Sequence
  Description of Artificial Sequence: Synthetic oligonucleotide
uccaucggucaugcucucg

SEQ ID NO: 1827 - RNA, 19 nt, Artificial Sequence
  Description of Artificial Sequence: Synthetic oligonucleotide
gagagcaugaccgauggau

SEQ ID NO: 1828 - RNA, 19 nt, Artificial Sequence
  Description of Artificial Sequence: Synthetic oligonucleotide
auccaucggucaugcucuc

SEQ ID NO: 1829 - RNA, 19 nt, Artificial Sequence
  Description of Artificial Sequence: Synthetic oligonucleotide
agagcaugaccgauggauu

SEQ ID NO: 1830 - RNA, 19 nt, Artificial Sequence
  Description of Artificial Sequence: Synthetic oligonucleotide
aauccaucggucaugcucu

SEQ ID NO: 1831 - RNA, 19 nt, Artificial Sequence
  Description of Artificial Sequence: Synthetic oligonucleotide
agcaugaccgauggauucc

SEQ ID NO: 1832 - RNA, 19 nt, Artificial Sequence
  Description of Artificial Sequence: Synthetic oligonucleotide
ggaauccaucggucaugcu

SEQ ID NO: 1833 - RNA, 19 nt, Artificial Sequence
  Description of Artificial Sequence: Synthetic oligonucleotide
gcaugaccgauggauucca

SEQ ID NO: 1834 - RNA, 19 nt, Artificial Sequence
  Description of Artificial Sequence: Synthetic oligonucleotide
uggaauccaucggucaugc

SEQ ID NO: 1835 - RNA, 19 nt, Artificial Sequence
  Description of Artificial Sequence: Synthetic oligonucleotide
augaccgauggauuccagu

SEQ ID NO: 1836 - RNA, 19 nt, Artificial Sequence
  Description of Artificial Sequence: Synthetic oligonucleotide
acuggaauccaucggucau

SEQ ID NO: 1837 - RNA, 19 nt, Artificial Sequence
  Description of Artificial Sequence: Synthetic oligonucleotide
gaccgauggauuccaguuc

SEQ ID NO: 1838 - RNA, 19 nt, Artificial Sequence
  Description of Artificial Sequence: Synthetic oligonucleotide
gaacuggaauccaucgguc

SEQ ID NO: 1839 - RNA, 19 nt, Artificial Sequence
  Description of Artificial Sequence: Synthetic oligonucleotide
accgauggauuccaguucg

SEQ ID NO: 1840 - RNA, 19 nt, Artificial Sequence
  Description of Artificial Sequence: Synthetic oligonucleotide
cgaacuggaauccaucggu

SEQ ID NO: 1841 - RNA, 19 nt, Artificial Sequence
  Description of Artificial Sequence: Synthetic oligonucleotide
ccgauggauuccaguucga

SEQ ID NO: 1842 - RNA, 19 nt, Artificial Sequence
  Description of Artificial Sequence: Synthetic oligonucleotide
ucgaacuggaauccaucgg

SEQ ID NO: 1843 - RNA, 19 nt, Artificial Sequence
  Description of Artificial Sequence: Synthetic oligonucleotide
auggauuccaguucgagua

SEQ ID NO: 1844 - RNA, 19 nt, Artificial Sequence
  Description of Artificial Sequence: Synthetic oligonucleotide
uacucgaacuggaauccau

SEQ ID NO: 1845 - RNA, 19 nt, Artificial Sequence
  Description of Artificial Sequence: Synthetic oligonucleotide
uggauuccaguucgaguau

SEQ ID NO: 1846 - RNA, 19 nt, Artificial Sequence
  Description of Artificial Sequence: Synthetic oligonucleotide
auacucgaacuggaaucca

SEQ ID NO: 1847 - RNA, 19 nt, Artificial Sequence
  Description of Artificial Sequence: Synthetic oligonucleotide
ggauuccaguucgaguaug

SEQ ID NO: 1848 - RNA, 19 nt, Artificial Sequence
  Description of Artificial Sequence: Synthetic oligonucleotide
cauacucgaacuggaaucc

SEQ ID NO: 1849 - RNA, 19 nt, Artificial Sequence
  Description of Artificial Sequence: Synthetic oligonucleotide
gauuccaguucgaguaugg

SEQ ID NO: 1850 - RNA, 19 nt, Artificial Sequence
  Description of Artificial Sequence: Synthetic oligonucleotide
ccauacucgaacuggaauc

SEQ ID NO: 1851 - RNA, 19 nt, Artificial Sequence
  Description of Artificial Sequence: Synthetic oligonucleotide
uccaguucgaguauggcgg

SEQ ID NO: 1852 - RNA, 19 nt, Artificial Sequence
  Description of Artificial Sequence: Synthetic oligonucleotide
ccgccauacucgaacugga

SEQ ID NO: 1853 - RNA, 19 nt, Artificial Sequence
  Description of Artificial Sequence: Synthetic oligonucleotide
ccaguucgaguauggcggc

SEQ ID NO: 1854 - RNA, 19 nt, Artificial Sequence
  Description of Artificial Sequence: Synthetic oligonucleotide
gccgccauacucgaacugg

SEQ ID NO: 1855 - RNA, 19 nt, Artificial Sequence
  Description of Artificial Sequence: Synthetic oligonucleotide
caguucgaguauggcggcc

SEQ ID NO: 1856 - RNA, 19 nt, Artificial Sequence
  Description of Artificial Sequence: Synthetic oligonucleotide
ggccgccauacucgaacug

SEQ ID NO: 1857 - RNA, 19 nt, Artificial Sequence
  Description of Artificial Sequence: Synthetic oligonucleotide
aguucgaguauggcggcca

SEQ ID NO: 1858 - RNA, 19 nt, Artificial Sequence
  Description of Artificial Sequence: Synthetic oligonucleotide
uggccgccauacucgaacu

SEQ ID NO: 1859 - RNA, 19 nt, Artificial Sequence
  Description of Artificial Sequence: Synthetic oligonucleotide
guucgaguauggcggccag

SEQ ID NO: 1860 - RNA, 19 nt, Artificial Sequence
  Description of Artificial Sequence: Synthetic oligonucleotide
cuggccgccauacucgaac

SEQ ID NO: 1861 - RNA, 19 nt, Artificial Sequence
  Description of Artificial Sequence: Synthetic oligonucleotide
uucgaguauggcggccagg

SEQ ID NO: 1862 - RNA, 19 nt, Artificial Sequence
  Description of Artificial Sequence: Synthetic oligonucleotide
ccuggccgccauacucgaa

SEQ ID NO: 1863 - RNA, 19 nt, Artificial Sequence
  Description of Artificial Sequence: Synthetic oligonucleotide
aguauggcggccagggcuc

SEQ ID NO: 1864 - RNA, 19 nt, Artificial Sequence
  Description of Artificial Sequence: Synthetic oligonucleotide
gagcccuggccgccauacu

SEQ ID NO: 1865 - RNA, 19 nt, Artificial Sequence
  Description of Artificial Sequence: Synthetic oligonucleotide
gggcuccgacccugccgau

SEQ ID NO: 1866 - RNA, 19 nt, Artificial Sequence
  Description of Artificial Sequence: Synthetic oligonucleotide
aucggcagggucggagccc

SEQ ID NO: 1867 - RNA, 19 nt, Artificial Sequence
  Description of Artificial Sequence: Synthetic oligonucleotide
gcuccgacccugccgaugu

SEQ ID NO: 1868 - RNA, 19 nt, Artificial Sequence
  Description of Artificial Sequence: Synthetic oligonucleotide
acaucggcagggucggagc

SEQ ID NO: 1869 - RNA, 19 nt, Artificial Sequence
  Description of Artificial Sequence: Synthetic oligonucleotide
cuccgacccugccgaugug

SEQ ID NO: 1870 - RNA, 19 nt, Artificial Sequence
  Description of Artificial Sequence: Synthetic oligonucleotide
cacaucggcagggucggag

SEQ ID NO: 1871 - RNA, 19 nt, Artificial Sequence
  Description of Artificial Sequence: Synthetic oligonucleotide
uccgacccugccgaugugg

SEQ ID NO: 1872 - RNA, 19 nt, Artificial Sequence
  Description of Artificial Sequence: Synthetic oligonucleotide
ccacaucggcagggucgga

SEQ ID NO: 1873 - RNA, 19 nt, Artificial Sequence
  Description of Artificial Sequence: Synthetic oligonucleotide
cugccgauguggccaucca

SEQ ID NO: 1874 - RNA, 19 nt, Artificial Sequence
  Description of Artificial Sequence: Synthetic oligonucleotide
uggauggccacaucggcag

SEQ ID NO: 1875 - RNA, 19 nt, Artificial Sequence
  Description of Artificial Sequence: Synthetic oligonucleotide
ugccgauguggccauccag

SEQ ID NO: 1876 - RNA, 19 nt, Artificial Sequence
  Description of Artificial Sequence: Synthetic oligonucleotide
cuggauggccacaucggca

SEQ ID NO: 1877 - RNA, 19 nt, Artificial Sequence
  Description of Artificial Sequence: Synthetic oligonucleotide
uggccauccagcugaccuu

SEQ ID NO: 1878 - RNA, 19 nt, Artificial Sequence
  Description of Artificial Sequence: Synthetic oligonucleotide
aaggucagcuggauggcca

SEQ ID NO: 1879 - RNA, 19 nt, Artificial Sequence
  Description of Artificial Sequence: Synthetic oligonucleotide
agcugaccuuccugcgccu

SEQ ID NO: 1880 - RNA, 19 nt, Artificial Sequence
  Description of Artificial Sequence: Synthetic oligonucleotide
aggcgcaggaaggucagcu

SEQ ID NO: 1881 - RNA, 19 nt, Artificial Sequence
  Description of Artificial Sequence: Synthetic oligonucleotide
cugcgccugauguccaccg

SEQ ID NO: 1882 - RNA, 19 nt, Artificial Sequence
  Description of Artificial Sequence: Synthetic oligonucleotide
cgguggacaucaggcgcag

SEQ ID NO: 1883 - RNA, 19 nt, Artificial Sequence
  Description of Artificial Sequence: Synthetic oligonucleotide
ugcgccugauguccaccga

SEQ ID NO: 1884 - RNA, 19 nt, Artificial Sequence
  Description of Artificial Sequence: Synthetic oligonucleotide
ucgguggacaucaggcgca

SEQ ID NO: 1885 - RNA, 19 nt, Artificial Sequence
  Description of Artificial Sequence: Synthetic oligonucleotide
gccugauguccaccgaggc

SEQ ID NO: 1886 - RNA, 19 nt, Artificial Sequence
  Description of Artificial Sequence: Synthetic oligonucleotide
gccucgguggacaucaggc

SEQ ID NO: 1887 - RNA, 19 nt, Artificial Sequence
  Description of Artificial Sequence: Synthetic oligonucleotide
ccugauguccaccgaggcc

SEQ ID NO: 1888 - RNA, 19 nt, Artificial Sequence
  Description of Artificial Sequence: Synthetic oligonucleotide
ggccucgguggacaucagg

SEQ ID NO: 1889 - RNA, 19 nt, Artificial Sequence
  Description of Artificial Sequence: Synthetic oligonucleotide
gaacagcguggccuacaug

SEQ ID NO: 1890 - RNA, 19 nt, Artificial Sequence
  Description of Artificial Sequence: Synthetic oligonucleotide
cauguaggccacgcuguuc

SEQ ID NO: 1891 - RNA, 19 nt, Artificial Sequence
  Description of Artificial Sequence: Synthetic oligonucleotide
aacagcguggccuacaugg

SEQ ID NO: 1892 - RNA, 19 nt, Artificial Sequence
  Description of Artificial Sequence: Synthetic oligonucleotide
ccauguaggccacgcuguu

SEQ ID NO: 1893 - RNA, 19 nt, Artificial Sequence
  Description of Artificial Sequence: Synthetic oligonucleotide
ggccuacauggaccagcag

SEQ ID NO: 1894 - RNA, 19 nt, Artificial Sequence
  Description of Artificial Sequence: Synthetic oligonucleotide
cugcugguccauguaggcc

SEQ ID NO: 1895 - RNA, 19 nt, Artificial Sequence
  Description of Artificial Sequence: Synthetic oligonucleotide
gccuacauggaccagcaga

SEQ ID NO: 1896 - RNA, 19 nt, Artificial Sequence
  Description of Artificial Sequence: Synthetic oligonucleotide
ucugcugguccauguaggc

SEQ ID NO: 1897 - RNA, 19 nt, Artificial Sequence
  Description of Artificial Sequence: Synthetic oligonucleotide
cagcagacuggcaaccuca

SEQ ID NO: 1898 - RNA, 19 nt, Artificial Sequence
  Description of Artificial Sequence: Synthetic oligonucleotide
ugagguugccagucugcug

SEQ ID NO: 1899 - RNA, 19 nt, Artificial Sequence
  Description of Artificial Sequence: Synthetic oligonucleotide
agcagacuggcaaccucaa

SEQ ID NO: 1900 - RNA, 19 nt, Artificial Sequence
  Description of Artificial Sequence: Synthetic oligonucleotide
uugagguugccagucugcu

SEQ ID NO: 1901 - RNA, 19 nt, Artificial Sequence
  Description of Artificial Sequence: Synthetic oligonucleotide
gcagacuggcaaccucaag

SEQ ID NO: 1902 - RNA, 19 nt, Artificial Sequence
  Description of Artificial Sequence: Synthetic oligonucleotide
cuugagguugccagucugc

SEQ ID NO: 1903 - RNA, 19 nt, Artificial Sequence
  Description of Artificial Sequence: Synthetic oligonucleotide
ccagggcuccaacgagauc

SEQ ID NO: 1904 - RNA, 19 nt, Artificial Sequence
  Description of Artificial Sequence: Synthetic oligonucleotide
gaucucguuggagcccugg

SEQ ID NO: 1905 - RNA, 19 nt, Artificial Sequence
  Description of Artificial Sequence: Synthetic oligonucleotide
cagggcuccaacgagaucg

SEQ ID NO: 1906 - RNA, 19 nt, Artificial Sequence
  Description of Artificial Sequence: Synthetic oligonucleotide
cgaucucguuggagcccug

SEQ ID NO: 1907 - RNA, 19 nt, Artificial Sequence
  Description of Artificial Sequence: Synthetic oligonucleotide
gggcuccaacgagaucgag

SEQ ID NO: 1908 - RNA, 19 nt, Artificial Sequence
  Description of Artificial Sequence: Synthetic oligonucleotide
cucgaucucguuggagccc

SEQ ID NO: 1909 - RNA, 19 nt, Artificial Sequence
  Description of Artificial Sequence: Synthetic oligonucleotide
ggcuccaacgagaucgaga

SEQ ID NO: 1910 - RNA, 19 nt, Artificial Sequence
  Description of Artificial Sequence: Synthetic oligonucleotide
ucucgaucucguuggagcc

SEQ ID NO: 1911 - RNA, 19 nt, Artificial Sequence
  Description of Artificial Sequence: Synthetic oligonucleotide
gcuccaacgagaucgagau

SEQ ID NO: 1912 - RNA, 19 nt, Artificial Sequence
  Description of Artificial Sequence: Synthetic oligonucleotide
aucucgaucucguuggagc

SEQ ID NO: 1913 - RNA, 19 nt, Artificial Sequence
  Description of Artificial Sequence: Synthetic oligonucleotide
caacgagaucgagauccgc

SEQ ID NO: 1914 - RNA, 19 nt, Artificial Sequence
  Description of Artificial Sequence: Synthetic oligonucleotide
gcggaucucgaucucguug

SEQ ID NO: 1915 - RNA, 19 nt, Artificial Sequence
  Description of Artificial Sequence: Synthetic oligonucleotide
aacgagaucgagauccgcg

SEQ ID NO: 1916 - RNA, 19 nt, Artificial Sequence
  Description of Artificial Sequence: Synthetic oligonucleotide
cgcggaucucgaucucguu

SEQ ID NO: 1917 - RNA, 19 nt, Artificial Sequence
  Description of Artificial Sequence: Synthetic oligonucleotide
acgagaucgagauccgcgc

SEQ ID NO: 1918 - RNA, 19 nt, Artificial Sequence
  Description of Artificial Sequence: Synthetic oligonucleotide
gcgcggaucucgaucucgu

SEQ ID NO: 1919 - RNA, 19 nt, Artificial Sequence
  Description of Artificial Sequence: Synthetic oligonucleotide
cgagggcaacagccgcuuc

SEQ ID NO: 1920 - RNA, 19 nt, Artificial Sequence
  Description of Artificial Sequence: Synthetic oligonucleotide
gaagcggcuguugcccucg

SEQ ID NO: 1921 - RNA, 19 nt, Artificial Sequence
  Description of Artificial Sequence: Synthetic oligonucleotide
caacagccgcuucaccuac

SEQ ID NO: 1922 - RNA, 19 nt, Artificial Sequence
  Description of Artificial Sequence: Synthetic oligonucleotide
guaggugaagcggcuguug

SEQ ID NO: 1923 - RNA, 19 nt, Artificial Sequence
  Description of Artificial Sequence: Synthetic oligonucleotide
aacagccgcuucaccuaca

SEQ ID NO: 1924 - RNA, 19 nt, Artificial Sequence
  Description of Artificial Sequence: Synthetic oligonucleotide
uguaggugaagcggcuguu

SEQ ID NO: 1925 - RNA, 19 nt, Artificial Sequence
  Description of Artificial Sequence: Synthetic oligonucleotide
acagccgcuucaccuacag

SEQ ID NO: 1926 - RNA, 19 nt, Artificial Sequence
  Description of Artificial Sequence: Synthetic oligonucleotide
cuguaggugaagcggcugu

SEQ ID NO: 1927 - RNA, 19 nt, Artificial Sequence
  Description of Artificial Sequence: Synthetic oligonucleotide
cagccgcuucaccuacagc

SEQ ID NO: 1928 - RNA, 19 nt, Artificial Sequence
  Description of Artificial Sequence: Synthetic oligonucleotide
gcuguaggugaagcggcug

SEQ ID NO: 1929 - RNA, 19 nt, Artificial Sequence
  Description of Artificial Sequence: Synthetic oligonucleotide
gccgcuucaccuacagcgu

SEQ ID NO: 1930 - RNA, 19 nt, Artificial Sequence
  Description of Artificial Sequence: Synthetic oligonucleotide
acgcuguaggugaagcggc

SEQ ID NO: 1931 - RNA, 19 nt, Artificial Sequence
  Description of Artificial Sequence: Synthetic oligonucleotide
ccgcuucaccuacagcguc

SEQ ID NO: 1932 - RNA, 19 nt, Artificial Sequence
  Description of Artificial Sequence: Synthetic oligonucleotide
gacgcuguaggugaagcgg

SEQ ID NO: 1933 - RNA, 19 nt, Artificial Sequence
  Description of Artificial Sequence: Synthetic oligonucleotide
cuucaccuacagcgucacu

SEQ ID NO: 1934 - RNA, 19 nt, Artificial Sequence
  Description of Artificial Sequence: Synthetic oligonucleotide
agugacgcuguaggugaag

SEQ ID NO: 1935 - RNA, 19 nt, Artificial Sequence
  Description of Artificial Sequence: Synthetic oligonucleotide
uucaccuacagcgucacug

SEQ ID NO: 1936 - RNA, 19 nt, Artificial Sequence
  Description of Artificial Sequence: Synthetic oligonucleotide
cagugacgcuguaggugaa

SEQ ID NO: 1937 - RNA, 19 nt, Artificial Sequence
  Description of Artificial Sequence: Synthetic oligonucleotide
ucaccuacagcgucacugu

SEQ ID NO: 1938 - RNA, 19 nt, Artificial Sequence
  Description of Artificial Sequence: Synthetic oligonucleotide
acagugacgcuguagguga

SEQ ID NO: 1939 - RNA, 19 nt, Artificial Sequence
  Description of Artificial Sequence: Synthetic oligonucleotide
ccuacagcgucacugucga

SEQ ID NO: 1940 - RNA, 19 nt, Artificial Sequence
  Description of Artificial Sequence: Synthetic oligonucleotide
ucgacagugacgcuguagg

SEQ ID NO: 1941 - RNA, 19 nt, Artificial Sequence
  Description of Artificial Sequence: Synthetic oligonucleotide
cuacagcgucacugucgau

SEQ ID NO: 1942 - RNA, 19 nt, Artificial Sequence
  Description of Artificial Sequence: Synthetic oligonucleotide
aucgacagugacgcuguag

SEQ ID NO: 1943 - RNA, 19 nt, Artificial Sequence
  Description of Artificial Sequence: Synthetic oligonucleotide
uacagcgucacugucgaug

SEQ ID NO: 1944 - RNA, 19 nt, Artificial Sequence
  Description of Artificial Sequence: Synthetic oligonucleotide
caucgacagugacgcugua

SEQ ID NO: 1945 - RNA, 19 nt, Artificial Sequence
  Description of Artificial Sequence: Synthetic oligonucleotide
acagcgucacugucgaugg

SEQ ID NO: 1946 - RNA, 19 nt, Artificial Sequence
  Description of Artificial Sequence: Synthetic oligonucleotide
ccaucgacagugacgcugu

SEQ ID NO: 1947 - RNA, 19 nt, Artificial Sequence
  Description of Artificial Sequence: Synthetic oligonucleotide
cagcgucacugucgauggc

SEQ ID NO: 1948 - RNA, 19 nt, Artificial Sequence
  Description of Artificial Sequence: Synthetic oligonucleotide
gccaucgacagugacgcug

SEQ ID NO: 1949 - RNA, 19 nt, Artificial Sequence
  Description of Artificial Sequence: Synthetic oligonucleotide
agcgucacugucgauggcu

SEQ ID NO: 1950 - RNA, 19 nt, Artificial Sequence
  Description of Artificial Sequence: Synthetic oligonucleotide
agccaucgacagugacgcu

SEQ ID NO: 1951 - RNA, 19 nt, Artificial Sequence
  Description of Artificial Sequence: Synthetic oligonucleotide
gcgucacugucgauggcug

SEQ ID NO: 1952 - RNA, 19 nt, Artificial Sequence
  Description of Artificial Sequence: Synthetic oligonucleotide
cagccaucgacagugacgc

SEQ ID NO: 1953 - RNA, 19 nt, Artificial Sequence
  Description of Artificial Sequence: Synthetic oligonucleotide
cgucacugucgauggcugc

SEQ ID NO: 1954 - RNA, 19 nt, Artificial Sequence
  Description of Artificial Sequence: Synthetic oligonucleotide
gcagccaucgacagugacg

SEQ ID NO: 1955 - RNA, 19 nt, Artificial Sequence
  Description of Artificial Sequence: Synthetic oligonucleotide
gucacugucgauggcugca

SEQ ID NO: 1956 - RNA, 19 nt, Artificial Sequence
  Description of Artificial Sequence: Synthetic oligonucleotide
ugcagccaucgacagugac

SEQ ID NO: 1957 - RNA, 19 nt, Artificial Sequence
  Description of Artificial Sequence: Synthetic oligonucleotide
cacugucgauggcugcacg

SEQ ID NO: 1958 - RNA, 19 nt, Artificial Sequence
  Description of Artificial Sequence: Synthetic oligonucleotide
cgugcagccaucgacagug

SEQ ID NO: 1959 - RNA, 19 nt, Artificial Sequence
  Description of Artificial Sequence: Synthetic oligonucleotide
acugucgauggcugcacga

SEQ ID NO: 1960 - RNA, 19 nt, Artificial Sequence
  Description of Artificial Sequence: Synthetic oligonucleotide
ucgugcagccaucgacagu

SEQ ID NO: 1961 - RNA, 19 nt, Artificial Sequence
  Description of Artificial Sequence: Synthetic oligonucleotide
gucgauggcugcacgaguc

SEQ ID NO: 1962 - RNA, 19 nt, Artificial Sequence
  Description of Artificial Sequence: Synthetic oligonucleotide
gacucgugcagccaucgac

SEQ ID NO: 1963 - RNA, 19 nt, Artificial Sequence
  Description of Artificial Sequence: Synthetic oligonucleotide
ucgauggcugcacgaguca

SEQ ID NO: 1964 - RNA, 19 nt, Artificial Sequence
  Description of Artificial Sequence: Synthetic oligonucleotide
ugacucgugcagccaucga

SEQ ID NO: 1965 - RNA, 19 nt, Artificial Sequence
  Description of Artificial Sequence: Synthetic oligonucleotide
cgauggcugcacgagucac

SEQ ID NO: 1966 - RNA, 19 nt, Artificial Sequence
  Description of Artificial Sequence: Synthetic oligonucleotide
gugacucgugcagccaucg

SEQ ID NO: 1967 - RNA, 19 nt, Artificial Sequence
  Description of Artificial Sequence: Synthetic oligonucleotide
uggcugcacgagucacacc

SEQ ID NO: 1968 - RNA, 19 nt, Artificial Sequence
  Description of Artificial Sequence: Synthetic oligonucleotide
ggugugacucgugcagcca

SEQ ID NO: 1969 - RNA, 19 nt, Artificial Sequence
  Description of Artificial Sequence: Synthetic oligonucleotide
ggcugcacgagucacaccg

SEQ ID NO: 1970 - RNA, 19 nt, Artificial Sequence
  Description of Artificial Sequence: Synthetic oligonucleotide
cggugugacucgugcagcc

SEQ ID NO: 1971 - RNA, 19 nt, Artificial Sequence
  Description of Artificial Sequence: Synthetic oligonucleotide
gcugcacgagucacaccgg

SEQ ID NO: 1972 - RNA, 19 nt, Artificial Sequence
  Description of Artificial Sequence: Synthetic oligonucleotide
ccggugugacucgugcagc

SEQ ID NO: 1973 - RNA, 19 nt, Artificial Sequence
  Description of Artificial Sequence: Synthetic oligonucleotide
cugcacgagucacaccgga

SEQ ID NO: 1974 - RNA, 19 nt, Artificial Sequence
  Description of Artificial Sequence: Synthetic oligonucleotide
uccggugugacucgugcag

SEQ ID NO: 1975 - RNA, 19 nt, Artificial Sequence
  Description of Artificial Sequence: Synthetic oligonucleotide
ugcacgagucacaccggag

SEQ ID NO: 1976 - RNA, 19 nt, Artificial Sequence
  Description of Artificial Sequence: Synthetic oligonucleotide
cuccggugugacucgugca

SEQ ID NO: 1977 - RNA, 19 nt, Artificial Sequence
  Description of Artificial Sequence: Synthetic oligonucleotide
gcacgagucacaccggagc

SEQ ID NO: 1978 - RNA, 19 nt, Artificial Sequence
  Description of Artificial Sequence: Synthetic oligonucleotide
gcuccggugugacucgugc

SEQ ID NO: 1979 - RNA, 19 nt, Artificial Sequence
  Description of Artificial Sequence: Synthetic oligonucleotide
cacgagucacaccggagcc

SEQ ID NO: 1980 - RNA, 19 nt, Artificial Sequence
  Description of Artificial Sequence: Synthetic oligonucleotide
ggcuccggugugacucgug

SEQ ID NO: 1981 - RNA, 19 nt, Artificial Sequence
  Description of Artificial Sequence: Synthetic oligonucleotide
acgagucacaccggagccu

SEQ ID NO: 1982 - RNA, 19 nt, Artificial Sequence
  Description of Artificial Sequence: Synthetic oligonucleotide
aggcuccggugugacucgu

SEQ ID NO: 1983 - RNA, 19 nt, Artificial Sequence
  Description of Artificial Sequence: Synthetic oligonucleotide
cgagucacaccggagccug

SEQ ID NO: 1984 - RNA, 19 nt, Artificial Sequence
  Description of Artificial Sequence: Synthetic oligonucleotide
caggcuccggugugacucg

SEQ ID NO: 1985 - RNA, 19 nt, Artificial Sequence
  Description of Artificial Sequence: Synthetic oligonucleotide
ggcaagacagugauugaau

SEQ ID NO: 1986 - RNA, 19 nt, Artificial Sequence
  Description of Artificial Sequence: Synthetic oligonucleotide
auucaaucacugucuugcc

SEQ ID NO: 1987 - RNA, 19 nt, Artificial Sequence
  Description of Artificial Sequence: Synthetic oligonucleotide
gcaagacagugauugaaua

SEQ ID NO: 1988 - RNA, 19 nt, Artificial Sequence
  Description of Artificial Sequence: Synthetic oligonucleotide
uauucaaucacugucuugc

SEQ ID NO: 1989 - RNA, 19 nt, Artificial Sequence
  Description of Artificial Sequence: Synthetic oligonucleotide
caagacagugauugaauac

SEQ ID NO: 1990 - RNA, 19 nt, Artificial Sequence
  Description of Artificial Sequence: Synthetic oligonucleotide
guauucaaucacugucuug

SEQ ID NO: 1991 - RNA, 19 nt, Artificial Sequence
  Description of Artificial Sequence: Synthetic oligonucleotide
gugauugaauacaaaacca

SEQ ID NO: 1992 - RNA, 19 nt, Artificial Sequence
  Description of Artificial Sequence: Synthetic oligonucleotide
ugguuuuguauucaaucac

SEQ ID NO: 1993 - RNA, 19 nt, Artificial Sequence
  Description of Artificial Sequence: Synthetic oligonucleotide
gauugaauacaaaaccacc

SEQ ID NO: 1994 - RNA, 19 nt, Artificial Sequence
  Description of Artificial Sequence: Synthetic oligonucleotide
ggugguuuuguauucaauc

SEQ ID NO: 1995 - RNA, 19 nt, Artificial Sequence
  Description of Artificial Sequence: Synthetic oligonucleotide
acaaaaccaccaagaccuc

SEQ ID NO: 1996 - RNA, 19 nt, Artificial Sequence
  Description of Artificial Sequence: Synthetic oligonucleotide
gaggucuuggugguuuugu

SEQ ID NO: 1997 - RNA, 19 nt, Artificial Sequence
  Description of Artificial Sequence: Synthetic oligonucleotide
aaccaccaagaccucccgc

SEQ ID NO: 1998 - RNA, 19 nt, Artificial Sequence
  Description of Artificial Sequence: Synthetic oligonucleotide
gcgggaggucuuggugguu

SEQ ID NO: 1999 - RNA, 19 nt, Artificial Sequence
  Description of Artificial Sequence: Synthetic oligonucleotide
accaccaagaccucccgcc

SEQ ID NO: 2000 - RNA, 19 nt, Artificial Sequence
  Description of Artificial Sequence: Synthetic oligonucleotide
ggcgggaggucuugguggu

SEQ ID NO: 2001 - RNA, 19 nt, Artificial Sequence
  Description of Artificial Sequence: Synthetic oligonucleotide
ccaccaagaccucccgccu

SEQ ID NO: 2002 - RNA, 19 nt, Artificial Sequence
  Description of Artificial Sequence: Synthetic oligonucleotide
aggcgggaggucuuggugg

SEQ ID NO: 2003 - RNA, 19 nt, Artificial Sequence
  Description of Artificial Sequence: Synthetic oligonucleotide
caccaagaccucccgccug

SEQ ID NO: 2004 - RNA, 19 nt, Artificial Sequence
  Description of Artificial Sequence: Synthetic oligonucleotide
caggcgggaggucuuggug

SEQ ID NO: 2005 - RNA, 19 nt, Artificial Sequence
  Description of Artificial Sequence: Synthetic oligonucleotide
ccgccugcccaucaucgau

SEQ ID NO: 2006 - RNA, 19 nt, Artificial Sequence
  Description of Artificial Sequence: Synthetic oligonucleotide
aucgaugaugggcaggcgg

SEQ ID NO: 2007 - RNA, 19 nt, Artificial Sequence
  Description of Artificial Sequence: Synthetic oligonucleotide
cgccugcccaucaucgaug

SEQ ID NO: 2008 - RNA, 19 nt, Artificial Sequence
  Description of Artificial Sequence: Synthetic oligonucleotide
caucgaugaugggcaggcg

SEQ ID NO: 2009 - RNA, 19 nt, Artificial Sequence
  Description of Artificial Sequence: Synthetic oligonucleotide
gccugcccaucaucgaugu

SEQ ID NO: 2010 - RNA, 19 nt, Artificial Sequence
  Description of Artificial Sequence: Synthetic oligonucleotide
acaucgaugaugggcaggc

SEQ ID NO: 2011 - RNA, 19 nt, Artificial Sequence
  Description of Artificial Sequence: Synthetic oligonucleotide
ccugcccaucaucgaugug

SEQ ID NO: 2012 - RNA, 19 nt, Artificial Sequence
  Description of Artificial Sequence: Synthetic oligonucleotide
cacaucgaugaugggcagg

SEQ ID NO: 2013 - RNA, 19 nt, Artificial Sequence
  Description of Artificial Sequence: Synthetic oligonucleotide
cugcccaucaucgaugugg

SEQ ID NO: 2014 - RNA, 19 nt, Artificial Sequence
  Description of Artificial Sequence: Synthetic oligonucleotide
ccacaucgaugaugggcag

SEQ ID NO: 2015 - RNA, 19 nt, Artificial Sequence
  Description of Artificial Sequence: Synthetic oligonucleotide
ucaucgauguggcccccuu

SEQ ID NO: 2016 - RNA, 19 nt, Artificial Sequence
  Description of Artificial Sequence: Synthetic oligonucleotide
aagggggccacaucgauga

SEQ ID NO: 2017 - RNA, 19 nt, Artificial Sequence
  Description of Artificial Sequence: Synthetic oligonucleotide
caucgauguggcccccuug

SEQ ID NO: 2018 - RNA, 19 nt, Artificial Sequence
  Description of Artificial Sequence: Synthetic oligonucleotide
caagggggccacaucgaug

SEQ ID NO: 2019 - RNA, 19 nt, Artificial Sequence
  Description of Artificial Sequence: Synthetic oligonucleotide
ucgauguggcccccuugga

SEQ ID NO: 2020 - RNA, 19 nt, Artificial Sequence
  Description of Artificial Sequence: Synthetic oligonucleotide
uccaagggggccacaucga

SEQ ID NO: 2021 - RNA, 19 nt, Artificial Sequence
  Description of Artificial Sequence: Synthetic oligonucleotide
uggcccccuuggacguugg

SEQ ID NO: 2022 - RNA, 19 nt, Artificial Sequence
  Description of Artificial Sequence: Synthetic oligonucleotide
ccaacguccaagggggcca

SEQ ID NO: 2023 - RNA, 19 nt, Artificial Sequence
  Description of Artificial Sequence: Synthetic oligonucleotide
ggcccccuuggacguuggu

SEQ ID NO: 2024 - RNA, 19 nt, Artificial Sequence
  Description of Artificial Sequence: Synthetic oligonucleotide
accaacguccaagggggcc

SEQ ID NO: 2025 - RNA, 19 nt, Artificial Sequence
  Description of Artificial Sequence: Synthetic oligonucleotide
cccccuuggacguuggugc

SEQ ID NO: 2026 - RNA, 19 nt, Artificial Sequence
  Description of Artificial Sequence: Synthetic oligonucleotide
gcaccaacguccaaggggg

SEQ ID NO: 2027 - RNA, 19 nt, Artificial Sequence
  Description of Artificial Sequence: Synthetic oligonucleotide
ccccuuggacguuggugcc

SEQ ID NO: 2028 - RNA, 19 nt, Artificial Sequence
  Description of Artificial Sequence: Synthetic oligonucleotide
ggcaccaacguccaagggg

SEQ ID NO: 2029 - RNA, 19 nt, Artificial Sequence
  Description of Artificial Sequence: Synthetic oligonucleotide
gacguuggugccccagacc

SEQ ID NO: 2030 - RNA, 19 nt, Artificial Sequence
  Description of Artificial Sequence: Synthetic oligonucleotide
ggucuggggcaccaacguc

SEQ ID NO: 2031 - RNA, 19 nt, Artificial Sequence
  Description of Artificial Sequence: Synthetic oligonucleotide
cguuggugccccagaccag

SEQ ID NO: 2032 - RNA, 19 nt, Artificial Sequence
  Description of Artificial Sequence: Synthetic oligonucleotide
cuggucuggggcaccaacg

SEQ ID NO: 2033 - RNA, 19 nt, Artificial Sequence
  Description of Artificial Sequence: Synthetic oligonucleotide
guuggugccccagaccagg

SEQ ID NO: 2034 - RNA, 19 nt, Artificial Sequence
  Description of Artificial Sequence: Synthetic oligonucleotide
ccuggucuggggcaccaac

SEQ ID NO: 2035 - RNA, 19 nt, Artificial Sequence
  Description of Artificial Sequence: Synthetic oligonucleotide
uuggugccccagaccagga

SEQ ID NO: 2036 - RNA, 19 nt, Artificial Sequence
  Description of Artificial Sequence: Synthetic oligonucleotide
uccuggucuggggcaccaa

SEQ ID NO: 2037 - RNA, 19 nt, Artificial Sequence
  Description of Artificial Sequence: Synthetic oligonucleotide
gugccccagaccaggaauu

SEQ ID NO: 2038 - RNA, 19 nt, Artificial Sequence
  Description of Artificial Sequence: Synthetic oligonucleotide
aauuccuggucuggggcac

SEQ ID NO: 2039 - RNA, 19 nt, Artificial Sequence
  Description of Artificial Sequence: Synthetic oligonucleotide
ugccccagaccaggaauuc

SEQ ID NO: 2040 - RNA, 19 nt, Artificial Sequence
  Description of Artificial Sequence: Synthetic oligonucleotide
gaauuccuggucuggggca

SEQ ID NO: 2041 - RNA, 19 nt, Artificial Sequence
  Description of Artificial Sequence: Synthetic oligonucleotide
cagaccaggaauucggcuu

SEQ ID NO: 2042 - RNA, 19 nt, Artificial Sequence
  Description of Artificial Sequence: Synthetic oligonucleotide
aagccgaauuccuggucug

SEQ ID NO: 2043 - RNA, 19 nt, Artificial Sequence
  Description of Artificial Sequence: Synthetic oligonucleotide
agaccaggaauucggcuuc

SEQ ID NO: 2044 - RNA, 19 nt, Artificial Sequence
  Description of Artificial Sequence: Synthetic oligonucleotide
gaagccgaauuccuggucu

SEQ ID NO: 2045 - RNA, 19 nt, Artificial Sequence
  Description of Artificial Sequence: Synthetic oligonucleotide
accaggaauucggcuucga

SEQ ID NO: 2046 - RNA, 19 nt, Artificial Sequence
  Description of Artificial Sequence: Synthetic oligonucleotide
ucgaagccgaauuccuggu

SEQ ID NO: 2047 - RNA, 19 nt, Artificial Sequence
  Description of Artificial Sequence: Synthetic oligonucleotide
ccaggaauucggcuucgac

SEQ ID NO: 2048 - RNA, 19 nt, Artificial Sequence
  Description of Artificial Sequence: Synthetic oligonucleotide
gucgaagccgaauuccugg

SEQ ID NO: 2049 - RNA, 19 nt, Artificial Sequence
  Description of Artificial Sequence: Synthetic oligonucleotide
ggaauucggcuucgacguu

SEQ ID NO: 2050 - RNA, 19 nt, Artificial Sequence
  Description of Artificial Sequence: Synthetic oligonucleotide
aacgucgaagccgaauucc

SEQ ID NO: 2051 - RNA, 19 nt, Artificial Sequence
  Description of Artificial Sequence: Synthetic oligonucleotide
gaauucggcuucgacguug

SEQ ID NO: 2052 - RNA, 19 nt, Artificial Sequence
  Description of Artificial Sequence: Synthetic oligonucleotide
caacgucgaagccgaauuc

SEQ ID NO: 2053 - RNA, 19 nt, Artificial Sequence
  Description of Artificial Sequence: Synthetic oligonucleotide
aauucggcuucgacguugg

SEQ ID NO: 2054 - RNA, 19 nt, Artificial Sequence
  Description of Artificial Sequence: Synthetic oligonucleotide
ccaacgucgaagccgaauu

SEQ ID NO: 2055 - RNA, 19 nt, Artificial Sequence
  Description of Artificial Sequence: Synthetic oligonucleotide
auucggcuucgacguuggc

SEQ ID NO: 2056 - RNA, 19 nt, Artificial Sequence
  Description of Artificial Sequence: Synthetic oligonucleotide
gccaacgucgaagccgaau

SEQ ID NO: 2057 - RNA, 19 nt, Artificial Sequence
  Description of Artificial Sequence: Synthetic oligonucleotide
uucggcuucgacguuggcc

SEQ ID NO: 2058 - RNA, 19 nt, Artificial Sequence
  Description of Artificial Sequence: Synthetic oligonucleotide
ggccaacgucgaagccgaa

SEQ ID NO: 2059 - RNA, 19 nt, Artificial Sequence
  Description of Artificial Sequence: Synthetic oligonucleotide
ucggcuucgacguuggccc

SEQ ID NO: 2060 - RNA, 19 nt, Artificial Sequence
  Description of Artificial Sequence: Synthetic oligonucleotide
gggccaacgucgaagccga

SEQ ID NO: 2061 - RNA, 19 nt, Artificial Sequence
  Description of Artificial Sequence: Synthetic oligonucleotide
cggcuucgacguuggcccu

SEQ ID NO: 2062 - RNA, 19 nt, Artificial Sequence
  Description of Artificial Sequence: Synthetic oligonucleotide
agggccaacgucgaagccg

SEQ ID NO: 2063 - RNA, 19 nt, Artificial Sequence
  Description of Artificial Sequence: Synthetic oligonucleotide
ggcuucgacguuggcccug

SEQ ID NO: 2064 - RNA, 19 nt, Artificial Sequence
  Description of Artificial Sequence: Synthetic oligonucleotide
cagggccaacgucgaagcc

SEQ ID NO: 2065 - RNA, 19 nt, Artificial Sequence
  Description of Artificial Sequence: Synthetic oligonucleotide
cuucgacguuggcccuguc

SEQ ID NO: 2066 - RNA, 19 nt, Artificial Sequence
  Description of Artificial Sequence: Synthetic oligonucleotide
gacagggccaacgucgaag

SEQ ID NO: 2067 - RNA, 19 nt, Artificial Sequence
  Description of Artificial Sequence: Synthetic oligonucleotide
uucgacguuggcccugucu

SEQ ID NO: 2068 - RNA, 19 nt, Artificial Sequence
  Description of Artificial Sequence: Synthetic oligonucleotide
agacagggccaacgucgaa

SEQ ID NO: 2069 - RNA, 19 nt, Artificial Sequence
  Description of Artificial Sequence: Synthetic oligonucleotide
ucgacguuggcccugucug

SEQ ID NO: 2070 - RNA, 19 nt, Artificial Sequence
  Description of Artificial Sequence: Synthetic oligonucleotide
cagacagggccaacgucga

SEQ ID NO: 2071 - RNA, 19 nt, Artificial Sequence
  Description of Artificial Sequence: Synthetic oligonucleotide
ucugcuuccuguaaacucc

SEQ ID NO: 2072 - RNA, 19 nt, Artificial Sequence
  Description of Artificial Sequence: Synthetic oligonucleotide
ggaguuuacaggaagcaga

SEQ ID NO: 2073 - RNA, 19 nt, Artificial Sequence
  Description of Artificial Sequence: Synthetic oligonucleotide
uuccuguaaacucccucca

SEQ ID NO: 2074 - RNA, 19 nt, Artificial Sequence
  Description of Artificial Sequence: Synthetic oligonucleotide
uggagggaguuuacaggaa

SEQ ID NO: 2075 - RNA, 19 nt, Artificial Sequence
  Description of Artificial Sequence: Synthetic oligonucleotide
uccuguaaacucccuccau

SEQ ID NO: 2076 - RNA, 19 nt, Artificial Sequence
  Description of Artificial Sequence: Synthetic oligonucleotide
auggagggaguuuacagga

SEQ ID NO: 2077 - RNA, 19 nt, Artificial Sequence
  Description of Artificial Sequence: Synthetic oligonucleotide
ucccacccaaccaacuuuc

SEQ ID NO: 2078 - RNA, 19 nt, Artificial Sequence
  Description of Artificial Sequence: Synthetic oligonucleotide
gaaaguugguuggguggga

SEQ ID NO: 2079 - RNA, 19 nt, Artificial Sequence
  Description of Artificial Sequence: Synthetic oligonucleotide
cccacccaaccaacuuucc

SEQ ID NO: 2080 - RNA, 19 nt, Artificial Sequence
  Description of Artificial Sequence: Synthetic oligonucleotide
ggaaaguugguuggguggg

SEQ ID NO: 2081 - RNA, 19 nt, Artificial Sequence
  Description of Artificial Sequence: Synthetic oligonucleotide
ccacccaaccaacuuuccc

SEQ ID NO: 2082 - RNA, 19 nt, Artificial Sequence
  Description of Artificial Sequence: Synthetic oligonucleotide
gggaaaguugguugggugg

SEQ ID NO: 2083 - RNA, 19 nt, Artificial Sequence
  Description of Artificial Sequence: Synthetic oligonucleotide
acccaaccaacuuuccccc

SEQ ID NO: 2084 - RNA, 19 nt, Artificial Sequence
  Description of Artificial Sequence: Synthetic oligonucleotide
gggggaaaguugguugggu

SEQ ID NO: 2085 - RNA, 19 nt, Artificial Sequence
  Description of Artificial Sequence: Synthetic oligonucleotide
accaacuuuccccccaacc

SEQ ID NO: 2086 - RNA, 19 nt, Artificial Sequence
  Description of Artificial Sequence: Synthetic oligonucleotide
gguuggggggaaaguuggu

SEQ ID NO: 2087 - RNA, 19 nt, Artificial Sequence
  Description of Artificial Sequence: Synthetic oligonucleotide
aacuuuccccccaacccgg

SEQ ID NO: 2088 - RNA, 19 nt, Artificial Sequence
  Description of Artificial Sequence: Synthetic oligonucleotide
ccggguuggggggaaaguu

SEQ ID NO: 2089 - RNA, 19 nt, Artificial Sequence
  Description of Artificial Sequence: Synthetic oligonucleotide
uuuccccccaacccggaaa

SEQ ID NO: 2090 - RNA, 19 nt, Artificial Sequence
  Description of Artificial Sequence: Synthetic oligonucleotide
uuuccggguuggggggaaa

SEQ ID NO: 2091 - RNA, 19 nt, Artificial Sequence
  Description of Artificial Sequence: Synthetic oligonucleotide
uuccccccaacccggaaac

SEQ ID NO: 2092 - RNA, 19 nt, Artificial Sequence
  Description of Artificial Sequence: Synthetic oligonucleotide
guuuccggguuggggggaa

SEQ ID NO: 2093 - RNA, 19 nt, Artificial Sequence
  Description of Artificial Sequence: Synthetic oligonucleotide
uccccccaacccggaaaca

SEQ ID NO: 2094 - RNA, 19 nt, Artificial Sequence
  Description of Artificial Sequence: Synthetic oligonucleotide
uguuuccggguugggggga

SEQ ID NO: 2095 - RNA, 19 nt, Artificial Sequence
  Description of Artificial Sequence: Synthetic oligonucleotide
ccccccaacccggaaacag

SEQ ID NO: 2096 - RNA, 19 nt, Artificial Sequence
  Description of Artificial Sequence: Synthetic oligonucleotide
cuguuuccggguugggggg

SEQ ID NO: 2097 - RNA, 19 nt, Artificial Sequence
  Description of Artificial Sequence: Synthetic oligonucleotide
cccaacccggaaacagaca

SEQ ID NO: 2098 - RNA, 19 nt, Artificial Sequence
  Description of Artificial Sequence: Synthetic oligonucleotide
ugucuguuuccggguuggg

SEQ ID NO: 2099 - RNA, 19 nt, Artificial Sequence
  Description of Artificial Sequence: Synthetic oligonucleotide
ccaacccggaaacagacaa

SEQ ID NO: 2100 - RNA, 19 nt, Artificial Sequence
  Description of Artificial Sequence: Synthetic oligonucleotide
uugucuguuuccggguugg

SEQ ID NO: 2101 - RNA, 19 nt, Artificial Sequence
  Description of Artificial Sequence: Synthetic oligonucleotide
caacccggaaacagacaag

SEQ ID NO: 2102 - RNA, 19 nt, Artificial Sequence
  Description of Artificial Sequence: Synthetic oligonucleotide
cuugucuguuuccggguug

SEQ ID NO: 2103 - RNA, 19 nt, Artificial Sequence
  Description of Artificial Sequence: Synthetic oligonucleotide
aacagacaagcaacccaaa

SEQ ID NO: 2104 - RNA, 19 nt, Artificial Sequence
  Description of Artificial Sequence: Synthetic oligonucleotide
uuuggguugcuugucuguu

SEQ ID NO: 2105 - RNA, 19 nt, Artificial Sequence
  Description of Artificial Sequence: Synthetic oligonucleotide
acaagcaacccaaacugaa

SEQ ID NO: 2106 - RNA, 19 nt, Artificial Sequence
  Description of Artificial Sequence: Synthetic oligonucleotide
uucaguuuggguugcuugu

SEQ ID NO: 2107 - RNA, 19 nt, Artificial Sequence
  Description of Artificial Sequence: Synthetic oligonucleotide
aagcaacccaaacugaacc

SEQ ID NO: 2108 - RNA, 19 nt, Artificial Sequence
  Description of Artificial Sequence: Synthetic oligonucleotide
gguucaguuuggguugcuu

SEQ ID NO: 2109 - RNA, 19 nt, Artificial Sequence
  Description of Artificial Sequence: Synthetic oligonucleotide
agcaacccaaacugaaccc

SEQ ID NO: 2110 - RNA, 19 nt, Artificial Sequence
  Description of Artificial Sequence: Synthetic oligonucleotide
ggguucaguuuggguugcu

SEQ ID NO: 2111 - RNA, 19 nt, Artificial Sequence
  Description of Artificial Sequence: Synthetic oligonucleotide
aacccaaacugaacccccu

SEQ ID NO: 2112 - RNA, 19 nt, Artificial Sequence
  Description of Artificial Sequence: Synthetic oligonucleotide
aggggguucaguuuggguu

SEQ ID NO: 2113 - RNA, 19 nt, Artificial Sequence
  Description of Artificial Sequence: Synthetic oligonucleotide
aaacugaacccccucaaaa

SEQ ID NO: 2114 - RNA, 19 nt, Artificial Sequence
  Description of Artificial Sequence: Synthetic oligonucleotide
uuuugaggggguucaguuu

SEQ ID NO: 2115 - RNA, 19 nt, Artificial Sequence
  Description of Artificial Sequence: Synthetic oligonucleotide
caaaaaaugggagacaauu

SEQ ID NO: 2116 - RNA, 19 nt, Artificial Sequence
  Description of Artificial Sequence: Synthetic oligonucleotide
aauugucucccauuuuuug

SEQ ID NO: 2117 - RNA, 19 nt, Artificial Sequence
  Description of Artificial Sequence: Synthetic oligonucleotide
aaaaugggagacaauuuca

SEQ ID NO: 2118 - RNA, 19 nt, Artificial Sequence
  Description of Artificial Sequence: Synthetic oligonucleotide
ugaaauugucucccauuuu

SEQ ID NO: 2119 - RNA, 19 nt, Artificial Sequence
  Description of Artificial Sequence: Synthetic oligonucleotide
ugggagacaauuucacaug

SEQ ID NO: 2120 - RNA, 19 nt, Artificial Sequence
  Description of Artificial Sequence: Synthetic oligonucleotide
caugugaaauugucuccca

SEQ ID NO: 2121 - RNA, 19 nt, Artificial Sequence
  Description of Artificial Sequence: Synthetic oligonucleotide
gggagacaauuucacaugg

SEQ ID NO: 2122 - RNA, 19 nt, Artificial Sequence
  Description of Artificial Sequence: Synthetic oligonucleotide
ccaugugaaauugucuccc

SEQ ID NO: 2123 - RNA, 19 nt, Artificial Sequence
  Description of Artificial Sequence: Synthetic oligonucleotide
ggagacaauuucacaugga

SEQ ID NO: 2124 - RNA, 19 nt, Artificial Sequence
  Description of Artificial Sequence: Synthetic oligonucleotide
uccaugugaaauugucucc

SEQ ID NO: 2125 - RNA, 19 nt, Artificial Sequence
  Description of Artificial Sequence: Synthetic oligonucleotide
gagacaauuucacauggac

SEQ ID NO: 2126 - RNA, 19 nt, Artificial Sequence
  Description of Artificial Sequence: Synthetic oligonucleotide
guccaugugaaauugucuc

SEQ ID NO: 2127 - RNA, 19 nt, Artificial Sequence
  Description of Artificial Sequence: Synthetic oligonucleotide
gacaauuucacauggacuu

SEQ ID NO: 2128 - RNA, 19 nt, Artificial Sequence
  Description of Artificial Sequence: Synthetic oligonucleotide
aaguccaugugaaauuguc

SEQ ID NO: 2129 - RNA, 19 nt, Artificial Sequence
  Description of Artificial Sequence: Synthetic oligonucleotide
caauuucacauggacuuug

SEQ ID NO: 2130 - RNA, 19 nt, Artificial Sequence
  Description of Artificial Sequence: Synthetic oligonucleotide
caaaguccaugugaaauug

SEQ ID NO: 2131 - RNA, 19 nt, Artificial Sequence
  Description of Artificial Sequence: Synthetic oligonucleotide
cauggacuuuggaaaauau

SEQ ID NO: 2132 - RNA, 19 nt, Artificial Sequence
  Description of Artificial Sequence: Synthetic oligonucleotide
auauuuuccaaaguccaug

SEQ ID NO: 2133 - RNA, 19 nt, Artificial Sequence
  Description of Artificial Sequence: Synthetic oligonucleotide
ccuuugcauucaucucuca

SEQ ID NO: 2134 - RNA, 19 nt, Artificial Sequence
  Description of Artificial Sequence: Synthetic oligonucleotide
ugagagaugaaugcaaagg

SEQ ID NO: 2135 - RNA, 19 nt, Artificial Sequence
  Description of Artificial Sequence: Synthetic oligonucleotide
cuuugcauucaucucucaa

SEQ ID NO: 2136 - RNA, 19 nt, Artificial Sequence
  Description of Artificial Sequence: Synthetic oligonucleotide
uugagagaugaaugcaaag

SEQ ID NO: 2137 - RNA, 19 nt, Artificial Sequence
  Description of Artificial Sequence: Synthetic oligonucleotide
uuugcauucaucucucaaa

SEQ ID NO: 2138 - RNA, 19 nt, Artificial Sequence
  Description of Artificial Sequence: Synthetic oligonucleotide
uuugagagaugaaugcaaa

SEQ ID NO: 2139 - RNA, 19 nt, Artificial Sequence
  Description of Artificial Sequence: Synthetic oligonucleotide
auucaucucucaaacuuag

SEQ ID NO: 2140 - RNA, 19 nt, Artificial Sequence
  Description of Artificial Sequence: Synthetic oligonucleotide
cuaaguuugagagaugaau

SEQ ID NO: 2141 - RNA, 19 nt, Artificial Sequence
  Description of Artificial Sequence: Synthetic oligonucleotide
uucaucucucaaacuuagu

SEQ ID NO: 2142 - RNA, 19 nt, Artificial Sequence
  Description of Artificial Sequence: Synthetic oligonucleotide
acuaaguuugagagaugaa

SEQ ID NO: 2143 - RNA, 19 nt, Artificial Sequence
  Description of Artificial Sequence: Synthetic oligonucleotide
ucaucucucaaacuuaguu

SEQ ID NO: 2144 - RNA, 19 nt, Artificial Sequence
  Description of Artificial Sequence: Synthetic oligonucleotide
aacuaaguuugagagauga

SEQ ID NO: 2145 - RNA, 19 nt, Artificial Sequence
  Description of Artificial Sequence: Synthetic oligonucleotide
caucucucaaacuuaguuu

SEQ ID NO: 2146 - RNA, 19 nt, Artificial Sequence
  Description of Artificial Sequence: Synthetic oligonucleotide
aaacuaaguuugagagaug

SEQ ID NO: 2147 - RNA, 19 nt, Artificial Sequence
  Description of Artificial Sequence: Synthetic oligonucleotide
aucucucaaacuuaguuuu

SEQ ID NO: 2148 - RNA, 19 nt, Artificial Sequence
  Description of Artificial Sequence: Synthetic oligonucleotide
aaaacuaaguuugagagau

SEQ ID NO: 2149 - RNA, 19 nt, Artificial Sequence
  Description of Artificial Sequence: Synthetic oligonucleotide
ucaaacuuaguuuuuaucu

SEQ ID NO: 2150 - RNA, 19 nt, Artificial Sequence
  Description of Artificial Sequence: Synthetic oligonucleotide
agauaaaaacuaaguuuga

SEQ ID NO: 2151 - RNA, 19 nt, Artificial Sequence
  Description of Artificial Sequence: Synthetic oligonucleotide
acuuaguuuuuaucuuuga

SEQ ID NO: 2152 - RNA, 19 nt, Artificial Sequence
  Description of Artificial Sequence: Synthetic oligonucleotide
ucaaagauaaaaacuaagu

SEQ ID NO: 2153 - RNA, 19 nt, Artificial Sequence
  Description of Artificial Sequence: Synthetic oligonucleotide
uaguuuuuaucuuugacca

SEQ ID NO: 2154 - RNA, 19 nt, Artificial Sequence
  Description of Artificial Sequence: Synthetic oligonucleotide
uggucaaagauaaaaacua

SEQ ID NO: 2155 - RNA, 19 nt, Artificial Sequence
  Description of Artificial Sequence: Synthetic oligonucleotide
guuuuuaucuuugaccaac

SEQ ID NO: 2156 - RNA, 19 nt, Artificial Sequence
  Description of Artificial Sequence: Synthetic oligonucleotide
guuggucaaagauaaaaac

SEQ ID NO: 2157 - RNA, 19 nt, Artificial Sequence
  Description of Artificial Sequence: Synthetic oligonucleotide
uuuuuaucuuugaccaacc

SEQ ID NO: 2158 - RNA, 19 nt, Artificial Sequence
  Description of Artificial Sequence: Synthetic oligonucleotide
gguuggucaaagauaaaaa

SEQ ID NO: 2159 - RNA, 19 nt, Artificial Sequence
  Description of Artificial Sequence: Synthetic oligonucleotide
uuuuaucuuugaccaaccg

SEQ ID NO: 2160 - RNA, 19 nt, Artificial Sequence
  Description of Artificial Sequence: Synthetic oligonucleotide
cgguuggucaaagauaaaa

SEQ ID NO: 2161 - RNA, 19 nt, Artificial Sequence
  Description of Artificial Sequence: Synthetic oligonucleotide
uuuaucuuugaccaaccga

SEQ ID NO: 2162 - RNA, 19 nt, Artificial Sequence
  Description of Artificial Sequence: Synthetic oligonucleotide
ucgguuggucaaagauaaa

SEQ ID NO: 2163 - RNA, 19 nt, Artificial Sequence
  Description of Artificial Sequence: Synthetic oligonucleotide
uuaucuuugaccaaccgaa

SEQ ID NO: 2164 - RNA, 19 nt, Artificial Sequence
  Description of Artificial Sequence: Synthetic oligonucleotide
uucgguuggucaaagauaa

SEQ ID NO: 2165 - RNA, 19 nt, Artificial Sequence
  Description of Artificial Sequence: Synthetic oligonucleotide
uaucuuugaccaaccgaac

SEQ ID NO: 2166 - RNA, 19 nt, Artificial Sequence
  Description of Artificial Sequence: Synthetic oligonucleotide
guucgguuggucaaagaua

SEQ ID NO: 2167 - RNA, 19 nt, Artificial Sequence
  Description of Artificial Sequence: Synthetic oligonucleotide
aucuuugaccaaccgaaca

SEQ ID NO: 2168 - RNA, 19 nt, Artificial Sequence
  Description of Artificial Sequence: Synthetic oligonucleotide
uguucgguuggucaaagau

SEQ ID NO: 2169 - RNA, 19 nt, Artificial Sequence
  Description of Artificial Sequence: Synthetic oligonucleotide
ucuuugaccaaccgaacau

SEQ ID NO: 2170 - RNA, 19 nt, Artificial Sequence
  Description of Artificial Sequence: Synthetic oligonucleotide
auguucgguuggucaaaga

SEQ ID NO: 2171 - RNA, 19 nt, Artificial Sequence
  Description of Artificial Sequence: Synthetic oligonucleotide
uuugaccaaccgaacauga

SEQ ID NO: 2172 - RNA, 19 nt, Artificial Sequence
  Description of Artificial Sequence: Synthetic oligonucleotide
ucauguucgguuggucaaa

SEQ ID NO: 2173 - RNA, 19 nt, Artificial Sequence
  Description of Artificial Sequence: Synthetic oligonucleotide
uugaccaaccgaacaugac

SEQ ID NO: 2174 - RNA, 19 nt, Artificial Sequence
  Description of Artificial Sequence: Synthetic oligonucleotide
gucauguucgguuggucaa

SEQ ID NO: 2175 - RNA, 19 nt, Artificial Sequence
  Description of Artificial Sequence: Synthetic oligonucleotide
ugaccaaccgaacaugacc

SEQ ID NO: 2176 - RNA, 19 nt, Artificial Sequence
  Description of Artificial Sequence: Synthetic oligonucleotide
ggucauguucgguugguca

SEQ ID NO: 2177 - RNA, 19 nt, Artificial Sequence
  Description of Artificial Sequence: Synthetic oligonucleotide
gaccaaccgaacaugacca

SEQ ID NO: 2178 - RNA, 19 nt, Artificial Sequence
  Description of Artificial Sequence: Synthetic oligonucleotide
uggucauguucgguugguc

SEQ ID NO: 2179 - RNA, 19 nt, Artificial Sequence
  Description of Artificial Sequence: Synthetic oligonucleotide
accaaccgaacaugaccaa

SEQ ID NO: 2180 - RNA, 19 nt, Artificial Sequence
  Description of Artificial Sequence: Synthetic oligonucleotide
uuggucauguucgguuggu

SEQ ID NO: 2181 - RNA, 19 nt, Artificial Sequence
  Description of Artificial Sequence: Synthetic oligonucleotide
ccgaacaugaccaaaaacc

SEQ ID NO: 2182 - RNA, 19 nt, Artificial Sequence
  Description of Artificial Sequence: Synthetic oligonucleotide
gguuuuuggucauguucgg

SEQ ID NO: 2183 - RNA, 19 nt, Artificial Sequence
  Description of Artificial Sequence: Synthetic oligonucleotide
cgaacaugaccaaaaacca

SEQ ID NO: 2184 - RNA, 19 nt, Artificial Sequence
  Description of Artificial Sequence: Synthetic oligonucleotide
ugguuuuuggucauguucg

SEQ ID NO: 2185 - RNA, 19 nt, Artificial Sequence
  Description of Artificial Sequence: Synthetic oligonucleotide
ugaccaaaaaccaaaagug

SEQ ID NO: 2186 - RNA, 19 nt, Artificial Sequence
  Description of Artificial Sequence: Synthetic oligonucleotide
cacuuuugguuuuugguca

SEQ ID NO: 2187 - RNA, 19 nt, Artificial Sequence
  Description of Artificial Sequence: Synthetic oligonucleotide
gaccaaaaaccaaaagugc

SEQ ID NO: 2188 - RNA, 19 nt, Artificial Sequence
  Description of Artificial Sequence: Synthetic oligonucleotide
gcacuuuugguuuuugguc

SEQ ID NO: 2189 - RNA, 19 nt, Artificial Sequence
  Description of Artificial Sequence: Synthetic oligonucleotide
aaaaaccaaaagugcauuc

SEQ ID NO: 2190 - RNA, 19 nt, Artificial Sequence
  Description of Artificial Sequence: Synthetic oligonucleotide
gaaugcacuuuugguuuuu

SEQ ID NO: 2191 - RNA, 19 nt, Artificial Sequence
  Description of Artificial Sequence: Synthetic oligonucleotide
aaaaccaaaagugcauuca

SEQ ID NO: 2192 - RNA, 19 nt, Artificial Sequence
  Description of Artificial Sequence: Synthetic oligonucleotide
ugaaugcacuuuugguuuu

SEQ ID NO: 2193 - RNA, 19 nt, Artificial Sequence
  Description of Artificial Sequence: Synthetic oligonucleotide
aaccaaaagugcauucaac

SEQ ID NO: 2194 - RNA, 19 nt, Artificial Sequence
  Description of Artificial Sequence: Synthetic oligonucleotide
guugaaugcacuuuugguu

SEQ ID NO: 2195 - RNA, 19 nt, Artificial Sequence
  Description of Artificial Sequence: Synthetic oligonucleotide
aagugcauucaaccuuacc

SEQ ID NO: 2196 - RNA, 19 nt, Artificial Sequence
  Description of Artificial Sequence: Synthetic oligonucleotide
gguaagguugaaugcacuu

SEQ ID NO: 2197 - RNA, 19 nt, Artificial Sequence
  Description of Artificial Sequence: Synthetic oligonucleotide
agugcauucaaccuuacca

SEQ ID NO: 2198 - RNA, 19 nt, Artificial Sequence
  Description of Artificial Sequence: Synthetic oligonucleotide
ugguaagguugaaugcacu

SEQ ID NO: 2199 - RNA, 19 nt, Artificial Sequence
  Description of Artificial Sequence: Synthetic oligonucleotide
gcauucaaccuuaccaaaa

SEQ ID NO: 2200 - RNA, 19 nt, Artificial Sequence
  Description of Artificial Sequence: Synthetic oligonucleotide
uuuugguaagguugaaugc

SEQ ID NO: 2201 - RNA, 19 nt, Artificial Sequence
  Description of Artificial Sequence: Synthetic oligonucleotide
cauucaaccuuaccaaaaa

SEQ ID NO: 2202 - RNA, 19 nt, Artificial Sequence
  Description of Artificial Sequence: Synthetic oligonucleotide
uuuuugguaagguugaaug

SEQ ID NO: 2203 - RNA, 19 nt, Artificial Sequence
  Description of Artificial Sequence: Synthetic oligonucleotide
aaaaaggaagcuuggucca

SEQ ID NO: 2204 - RNA, 19 nt, Artificial Sequence
  Description of Artificial Sequence: Synthetic oligonucleotide
uggaccaagcuuccuuuuu

SEQ ID NO: 2205 - RNA, 19 nt, Artificial Sequence
  Description of Artificial Sequence: Synthetic oligonucleotide
aaaaggaagcuugguccac

SEQ ID NO: 2206 - RNA, 19 nt, Artificial Sequence
  Description of Artificial Sequence: Synthetic oligonucleotide
guggaccaagcuuccuuuu

SEQ ID NO: 2207 - RNA, 19 nt, Artificial Sequence
  Description of Artificial Sequence: Synthetic oligonucleotide
aaaggaagcuugguccacu

SEQ ID NO: 2208 - RNA, 19 nt, Artificial Sequence
  Description of Artificial Sequence: Synthetic oligonucleotide
aguggaccaagcuuccuuu

SEQ ID NO: 2209 - RNA, 19 nt, Artificial Sequence
  Description of Artificial Sequence: Synthetic oligonucleotide
aaggaagcuugguccacuu

SEQ ID NO: 2210 - RNA, 19 nt, Artificial Sequence
  Description of Artificial Sequence: Synthetic oligonucleotide
aaguggaccaagcuuccuu

SEQ ID NO: 2211 - RNA, 19 nt, Artificial Sequence
  Description of Artificial Sequence: Synthetic oligonucleotide
aggaagcuugguccacuug

SEQ ID NO: 2212 - RNA, 19 nt, Artificial Sequence
  Description of Artificial Sequence: Synthetic oligonucleotide
caaguggaccaagcuuccu

SEQ ID NO: 2213 - RNA, 19 nt, Artificial Sequence
  Description of Artificial Sequence: Synthetic oligonucleotide
ggaagcuugguccacuugc

SEQ ID NO: 2214 - RNA, 19 nt, Artificial Sequence
  Description of Artificial Sequence: Synthetic oligonucleotide
gcaaguggaccaagcuucc

SEQ ID NO: 2215 - RNA, 19 nt, Artificial Sequence
  Description of Artificial Sequence: Synthetic oligonucleotide
gaagcuugguccacuugcu

SEQ ID NO: 2216 - RNA, 19 nt, Artificial Sequence
  Description of Artificial Sequence: Synthetic oligonucleotide
agcaaguggaccaagcuuc

SEQ ID NO: 2217 - RNA, 19 nt, Artificial Sequence
  Description of Artificial Sequence: Synthetic oligonucleotide
aagcuugguccacuugcuu

SEQ ID NO: 2218 - RNA, 19 nt, Artificial Sequence
  Description of Artificial Sequence: Synthetic oligonucleotide
aagcaaguggaccaagcuu

SEQ ID NO: 2219 - RNA, 19 nt, Artificial Sequence
  Description of Artificial Sequence: Synthetic oligonucleotide
agcuugguccacuugcuug

SEQ ID NO: 2220 - RNA, 19 nt, Artificial Sequence
  Description of Artificial Sequence: Synthetic oligonucleotide
caagcaaguggaccaagcu

SEQ ID NO: 2221 - RNA, 19 nt, Artificial Sequence
  Description of Artificial Sequence: Synthetic oligonucleotide
guccacuugcuugaagacc

SEQ ID NO: 2222 - RNA, 19 nt, Artificial Sequence
  Description of Artificial Sequence: Synthetic oligonucleotide
ggucuucaagcaaguggac

SEQ ID NO: 2223 - RNA, 19 nt, Artificial Sequence
  Description of Artificial Sequence: Synthetic oligonucleotide
uccacuugcuugaagaccc

SEQ ID NO: 2224 - RNA, 19 nt, Artificial Sequence
  Description of Artificial Sequence: Synthetic oligonucleotide
gggucuucaagcaagugga

SEQ ID NO: 2225 - RNA, 19 nt, Artificial Sequence
  Description of Artificial Sequence: Synthetic oligonucleotide
ugcuugaagacccaugcgg

SEQ ID NO: 2226 - RNA, 19 nt, Artificial Sequence
  Description of Artificial Sequence: Synthetic oligonucleotide
ccgcaugggucuucaagca

SEQ ID NO: 2227 - RNA, 19 nt, Artificial Sequence
  Description of Artificial Sequence: Synthetic oligonucleotide
gcuugaagacccaugcggg

SEQ ID NO: 2228 - RNA, 19 nt, Artificial Sequence
  Description of Artificial Sequence: Synthetic oligonucleotide
cccgcaugggucuucaagc

SEQ ID NO: 2229 - RNA, 19 nt, Artificial Sequence
  Description of Artificial Sequence: Synthetic oligonucleotide
cuugaagacccaugcgggg

SEQ ID NO: 2230 - RNA, 19 nt, Artificial Sequence
  Description of Artificial Sequence: Synthetic oligonucleotide
ccccgcaugggucuucaag

SEQ ID NO: 2231 - RNA, 19 nt, Artificial Sequence
  Description of Artificial Sequence: Synthetic oligonucleotide
uugaagacccaugcggggg

SEQ ID NO: 2232 - RNA, 19 nt, Artificial Sequence
  Description of Artificial Sequence: Synthetic oligonucleotide
cccccgcaugggucuucaa

SEQ ID NO: 2233 - RNA, 19 nt, Artificial Sequence
  Description of Artificial Sequence: Synthetic oligonucleotide
ugaagacccaugcgggggu

SEQ ID NO: 2234 - RNA, 19 nt, Artificial Sequence
  Description of Artificial Sequence: Synthetic oligonucleotide
acccccgcaugggucuuca

SEQ ID NO: 2235 - RNA, 19 nt, Artificial Sequence
  Description of Artificial Sequence: Synthetic oligonucleotide
aagacccaugcggggguaa

SEQ ID NO: 2236 - RNA, 19 nt, Artificial Sequence
  Description of Artificial Sequence: Synthetic oligonucleotide
uuacccccgcaugggucuu

SEQ ID NO: 2237 - RNA, 19 nt, Artificial Sequence
  Description of Artificial Sequence: Synthetic oligonucleotide
agacccaugcggggguaag

SEQ ID NO: 2238 - RNA, 19 nt, Artificial Sequence
  Description of Artificial Sequence: Synthetic oligonucleotide
cuuacccccgcaugggucu

SEQ ID NO: 2239 - RNA, 19 nt, Artificial Sequence
  Description of Artificial Sequence: Synthetic oligonucleotide
gacccaugcggggguaagu

SEQ ID NO: 2240 - RNA, 19 nt, Artificial Sequence
  Description of Artificial Sequence: Synthetic oligonucleotide
acuuacccccgcauggguc

SEQ ID NO: 2241 - RNA, 19 nt, Artificial Sequence
  Description of Artificial Sequence: Synthetic oligonucleotide
acccaugcggggguaaguc

SEQ ID NO: 2242 - RNA, 19 nt, Artificial Sequence
  Description of Artificial Sequence: Synthetic oligonucleotide
gacuuacccccgcaugggu

SEQ ID NO: 2243 - RNA, 19 nt, Artificial Sequence
  Description of Artificial Sequence: Synthetic oligonucleotide
cccaugcggggguaagucc

SEQ ID NO: 2244 - RNA, 19 nt, Artificial Sequence
  Description of Artificial Sequence: Synthetic oligonucleotide
ggacuuacccccgcauggg

SEQ ID NO: 2245 - RNA, 19 nt, Artificial Sequence
  Description of Artificial Sequence: Synthetic oligonucleotide
ccaugcggggguaaguccc

SEQ ID NO: 2246 - RNA, 19 nt, Artificial Sequence
  Description of Artificial Sequence: Synthetic oligonucleotide
gggacuuacccccgcaugg

SEQ ID NO: 2247 - RNA, 19 nt, Artificial Sequence
  Description of Artificial Sequence: Synthetic oligonucleotide
caugcggggguaagucccu

SEQ ID NO: 2248 - RNA, 19 nt, Artificial Sequence
  Description of Artificial Sequence: Synthetic oligonucleotide
agggacuuacccccgcaug

SEQ ID NO: 2249 - RNA, 19 nt, Artificial Sequence
  Description of Artificial Sequence: Synthetic oligonucleotide
ggguaagucccuuucugcc

SEQ ID NO: 2250 - RNA, 19 nt, Artificial Sequence
  Description of Artificial Sequence: Synthetic oligonucleotide
ggcagaaagggacuuaccc

SEQ ID NO: 2251 - RNA, 19 nt, Artificial Sequence
  Description of Artificial Sequence: Synthetic oligonucleotide
gguaagucccuuucugccc

SEQ ID NO: 2252 - RNA, 19 nt, Artificial Sequence
  Description of Artificial Sequence: Synthetic oligonucleotide
gggcagaaagggacuuacc

SEQ ID NO: 2253 - RNA, 19 nt, Artificial Sequence
  Description of Artificial Sequence: Synthetic oligonucleotide
guaagucccuuucugcccg

SEQ ID NO: 2254 - RNA, 19 nt, Artificial Sequence
  Description of Artificial Sequence: Synthetic oligonucleotide
cgggcagaaagggacuuac

SEQ ID NO: 2255 - RNA, 19 nt, Artificial Sequence
  Description of Artificial Sequence: Synthetic oligonucleotide
uaagucccuuucugcccgu

SEQ ID NO: 2256 - RNA, 19 nt, Artificial Sequence
  Description of Artificial Sequence: Synthetic oligonucleotide
acgggcagaaagggacuua

SEQ ID NO: 2257 - RNA, 19 nt, Artificial Sequence
  Description of Artificial Sequence: Synthetic oligonucleotide
ucccuuucugcccguuggg

SEQ ID NO: 2258 - RNA, 19 nt, Artificial Sequence
  Description of Artificial Sequence: Synthetic oligonucleotide
cccaacgggcagaaaggga

SEQ ID NO: 2259 - RNA, 19 nt, Artificial Sequence
  Description of Artificial Sequence: Synthetic oligonucleotide
cccuuucugcccguugggc

SEQ ID NO: 2260 - RNA, 19 nt, Artificial Sequence
  Description of Artificial Sequence: Synthetic oligonucleotide
gcccaacgggcagaaaggg

SEQ ID NO: 2261 - RNA, 19 nt, Artificial Sequence
  Description of Artificial Sequence: Synthetic oligonucleotide
cuuucugcccguugggcuu

SEQ ID NO: 2262 - RNA, 19 nt, Artificial Sequence
  Description of Artificial Sequence: Synthetic oligonucleotide
aagcccaacgggcagaaag

SEQ ID NO: 2263 - RNA, 19 nt, Artificial Sequence
  Description of Artificial Sequence: Synthetic oligonucleotide
uuucugcccguugggcuua

SEQ ID NO: 2264 - RNA, 19 nt, Artificial Sequence
  Description of Artificial Sequence: Synthetic oligonucleotide
uaagcccaacgggcagaaa

SEQ ID NO: 2265 - RNA, 19 nt, Artificial Sequence
  Description of Artificial Sequence: Synthetic oligonucleotide
uucugcccguugggcuuau

SEQ ID NO: 2266 - RNA, 19 nt, Artificial Sequence
  Description of Artificial Sequence: Synthetic oligonucleotide
auaagcccaacgggcagaa

SEQ ID NO: 2267 - RNA, 19 nt, Artificial Sequence
  Description of Artificial Sequence: Synthetic oligonucleotide
cccguugggcuuaugaaac

SEQ ID NO: 2268 - RNA, 19 nt, Artificial Sequence
  Description of Artificial Sequence: Synthetic oligonucleotide
guuucauaagcccaacggg

SEQ ID NO: 2269 - RNA, 19 nt, Artificial Sequence
  Description of Artificial Sequence: Synthetic oligonucleotide
ccguugggcuuaugaaacc

SEQ ID NO: 2270 - RNA, 19 nt, Artificial Sequence
  Description of Artificial Sequence: Synthetic oligonucleotide
gguuucauaagcccaacgg

SEQ ID NO: 2271 - RNA, 19 nt, Artificial Sequence
  Description of Artificial Sequence: Synthetic oligonucleotide
cguugggcuuaugaaaccc

SEQ ID NO: 2272 - RNA, 19 nt, Artificial Sequence
  Description of Artificial Sequence: Synthetic oligonucleotide
ggguuucauaagcccaacg

SEQ ID NO: 2273 - RNA, 19 nt, Artificial Sequence
  Description of Artificial Sequence: Synthetic oligonucleotide
gggcuuaugaaaccccaau

SEQ ID NO: 2274 - RNA, 19 nt, Artificial Sequence
  Description of Artificial Sequence: Synthetic oligonucleotide
auugggguuucauaagccc

SEQ ID NO: 2275 - RNA, 19 nt, Artificial Sequence
  Description of Artificial Sequence: Synthetic oligonucleotide
ggcuuaugaaaccccaaug

SEQ ID NO: 2276 - RNA, 19 nt, Artificial Sequence
  Description of Artificial Sequence: Synthetic oligonucleotide
cauugggguuucauaagcc

SEQ ID NO: 2277 - RNA, 19 nt, Artificial Sequence
  Description of Artificial Sequence: Synthetic oligonucleotide
gcuuaugaaaccccaaugc

SEQ ID NO: 2278 - RNA, 19 nt, Artificial Sequence
  Description of Artificial Sequence: Synthetic oligonucleotide
gcauugggguuucauaagc

SEQ ID NO: 2279 - RNA, 19 nt, Artificial Sequence
  Description of Artificial Sequence: Synthetic oligonucleotide
cuuaugaaaccccaaugcu

SEQ ID NO: 2280 - RNA, 19 nt, Artificial Sequence
  Description of Artificial Sequence: Synthetic oligonucleotide
agcauugggguuucauaag

SEQ ID NO: 2281 - RNA, 19 nt, Artificial Sequence
  Description of Artificial Sequence: Synthetic oligonucleotide
uaugaaaccccaaugcugc

SEQ ID NO: 2282 - RNA, 19 nt, Artificial Sequence
  Description of Artificial Sequence: Synthetic oligonucleotide
gcagcauugggguuucaua

SEQ ID NO: 2283 - RNA, 19 nt, Artificial Sequence
  Description of Artificial Sequence: Synthetic oligonucleotide
gaaaccccaaugcugcccu

SEQ ID NO: 2284 - RNA, 19 nt, Artificial Sequence
  Description of Artificial Sequence: Synthetic oligonucleotide
agggcagcauugggguuuc

SEQ ID NO: 2285 - RNA, 19 nt, Artificial Sequence
  Description of Artificial Sequence: Synthetic oligonucleotide
aaaccccaaugcugcccuu

SEQ ID NO: 2286 - RNA, 19 nt, Artificial Sequence
  Description of Artificial Sequence: Synthetic oligonucleotide
aagggcagcauugggguuu

SEQ ID NO: 2287 - RNA, 19 nt, Artificial Sequence
  Description of Artificial Sequence: Synthetic oligonucleotide
ugcuccuuucuccacaccc

SEQ ID NO: 2288 - RNA, 19 nt, Artificial Sequence
  Description of Artificial Sequence: Synthetic oligonucleotide
ggguguggagaaaggagca

SEQ ID NO: 2289 - RNA, 19 nt, Artificial Sequence
  Description of Artificial Sequence: Synthetic oligonucleotide
uuucuccacaccccccuug

SEQ ID NO: 2290 - RNA, 19 nt, Artificial Sequence
  Description of Artificial Sequence: Synthetic oligonucleotide
caagggggguguggagaaa

SEQ ID NO: 2291 - RNA, 19 nt, Artificial Sequence
  Description of Artificial Sequence: Synthetic oligonucleotide
ucuccacaccccccuuggg

SEQ ID NO: 2292 - RNA, 19 nt, Artificial Sequence
  Description of Artificial Sequence: Synthetic oligonucleotide
cccaagggggguguggaga

SEQ ID NO: 2293 - RNA, 19 nt, Artificial Sequence
  Description of Artificial Sequence: Synthetic oligonucleotide
acaccccccuuggggccuc

SEQ ID NO: 2294 - RNA, 19 nt, Artificial Sequence
  Description of Artificial Sequence: Synthetic oligonucleotide
gaggccccaaggggggugu

SEQ ID NO: 2295 - RNA, 19 nt, Artificial Sequence
  Description of Artificial Sequence: Synthetic oligonucleotide
cccuuggggccuccccucc

SEQ ID NO: 2296 - RNA, 19 nt, Artificial Sequence
  Description of Artificial Sequence: Synthetic oligonucleotide
ggaggggaggccccaaggg

SEQ ID NO: 2297 - RNA, 19 nt, Artificial Sequence
  Description of Artificial Sequence: Synthetic oligonucleotide
cuccacuccuucccaaauc

SEQ ID NO: 2298 - RNA, 19 nt, Artificial Sequence
  Description of Artificial Sequence: Synthetic oligonucleotide
gauuugggaaggaguggag

SEQ ID NO: 2299 - RNA, 19 nt, Artificial Sequence
  Description of Artificial Sequence: Synthetic oligonucleotide
acuccuucccaaaucuguc

SEQ ID NO: 2300 - RNA, 19 nt, Artificial Sequence
  Description of Artificial Sequence: Synthetic oligonucleotide
gacagauuugggaaggagu

SEQ ID NO: 2301 - RNA, 19 nt, Artificial Sequence
  Description of Artificial Sequence: Synthetic oligonucleotide
cuccuucccaaaucugucu

SEQ ID NO: 2302 - RNA, 19 nt, Artificial Sequence
  Description of Artificial Sequence: Synthetic oligonucleotide
agacagauuugggaaggag

SEQ ID NO: 2303 - RNA, 19 nt, Artificial Sequence
  Description of Artificial Sequence: Synthetic oligonucleotide
ccaaaucugucuccccaga

SEQ ID NO: 2304 - RNA, 19 nt, Artificial Sequence
  Description of Artificial Sequence: Synthetic oligonucleotide
ucuggggagacagauuugg

SEQ ID NO: 2305 - RNA, 19 nt, Artificial Sequence
  Description of Artificial Sequence: Synthetic oligonucleotide
caaaucugucuccccagaa

SEQ ID NO: 2306 - RNA, 19 nt, Artificial Sequence
  Description of Artificial Sequence: Synthetic oligonucleotide
uucuggggagacagauuug

SEQ ID NO: 2307 - RNA, 19 nt, Artificial Sequence
  Description of Artificial Sequence: Synthetic oligonucleotide
gacacaggaaacaauguau

SEQ ID NO: 2308 - RNA, 19 nt, Artificial Sequence
  Description of Artificial Sequence: Synthetic oligonucleotide
auacauuguuuccuguguc

SEQ ID NO: 2309 - RNA, 19 nt, Artificial Sequence
  Description of Artificial Sequence: Synthetic oligonucleotide
caggaaacaauguauuguc

SEQ ID NO: 2310 - RNA, 19 nt, Artificial Sequence
  Description of Artificial Sequence: Synthetic oligonucleotide
gacaauacauuguuuccug

SEQ ID NO: 2311 - RNA, 19 nt, Artificial Sequence
  Description of Artificial Sequence: Synthetic oligonucleotide
aggaaacaauguauugucu

SEQ ID NO: 2312 - RNA, 19 nt, Artificial Sequence
  Description of Artificial Sequence: Synthetic oligonucleotide
agacaauacauuguuuccu

SEQ ID NO: 2313 - RNA, 19 nt, Artificial Sequence
  Description of Artificial Sequence: Synthetic oligonucleotide
ggaaacaauguauugucug

SEQ ID NO: 2314 - RNA, 19 nt, Artificial Sequence
  Description of Artificial Sequence: Synthetic oligonucleotide
cagacaauacauuguuucc

SEQ ID NO: 2315 - RNA, 19 nt, Artificial Sequence
  Description of Artificial Sequence: Synthetic oligonucleotide
gaaacaauguauugucugc

SEQ ID NO: 2316 - RNA, 19 nt, Artificial Sequence
  Description of Artificial Sequence: Synthetic oligonucleotide
gcagacaauacauuguuuc

SEQ ID NO: 2317 - RNA, 19 nt, Artificial Sequence
  Description of Artificial Sequence: Synthetic oligonucleotide
acaauguauugucugccca

SEQ ID NO: 2318 - RNA, 19 nt, Artificial Sequence
  Description of Artificial Sequence: Synthetic oligonucleotide
ugggcagacaauacauugu

SEQ ID NO: 2319 - RNA, 19 nt, Artificial Sequence
  Description of Artificial Sequence: Synthetic oligonucleotide
caauguauugucugcccag

SEQ ID NO: 2320 - RNA, 19 nt, Artificial Sequence
  Description of Artificial Sequence: Synthetic oligonucleotide
cugggcagacaauacauug

SEQ ID NO: 2321 - RNA, 19 nt, Artificial Sequence
  Description of Artificial Sequence: Synthetic oligonucleotide
uguauugucugcccagcaa

SEQ ID NO: 2322 - RNA, 19 nt, Artificial Sequence
  Description of Artificial Sequence: Synthetic oligonucleotide
uugcugggcagacaauaca

SEQ ID NO: 2323 - RNA, 19 nt, Artificial Sequence
  Description of Artificial Sequence: Synthetic oligonucleotide
guauugucugcccagcaau

SEQ ID NO: 2324 - RNA, 19 nt, Artificial Sequence
  Description of Artificial Sequence: Synthetic oligonucleotide
auugcugggcagacaauac

SEQ ID NO: 2325 - RNA, 19 nt, Artificial Sequence
  Description of Artificial Sequence: Synthetic oligonucleotide
uauugucugcccagcaauc

SEQ ID NO: 2326 - RNA, 19 nt, Artificial Sequence
  Description of Artificial Sequence: Synthetic oligonucleotide
gauugcugggcagacaaua

SEQ ID NO: 2327 - RNA, 19 nt, Artificial Sequence
  Description of Artificial Sequence: Synthetic oligonucleotide
gucugcccagcaaucaaag

SEQ ID NO: 2328 - RNA, 19 nt, Artificial Sequence
  Description of Artificial Sequence: Synthetic oligonucleotide
cuuugauugcugggcagac

SEQ ID NO: 2329 - RNA, 19 nt, Artificial Sequence
  Description of Artificial Sequence: Synthetic oligonucleotide
cugcccagcaaucaaaggc

SEQ ID NO: 2330 - RNA, 19 nt, Artificial Sequence
  Description of Artificial Sequence: Synthetic oligonucleotide
gccuuugauugcugggcag

SEQ ID NO: 2331 - RNA, 19 nt, Artificial Sequence
  Description of Artificial Sequence: Synthetic oligonucleotide
ugcccagcaaucaaaggca

SEQ ID NO: 2332 - RNA, 19 nt, Artificial Sequence
  Description of Artificial Sequence: Synthetic oligonucleotide
ugccuuugauugcugggca

SEQ ID NO: 2333 - RNA, 19 nt, Artificial Sequence
  Description of Artificial Sequence: Synthetic oligonucleotide
ccagcaaucaaaggcaaug

SEQ ID NO: 2334 - RNA, 19 nt, Artificial Sequence
  Description of Artificial Sequence: Synthetic oligonucleotide
cauugccuuugauugcugg

SEQ ID NO: 2335 - RNA, 19 nt, Artificial Sequence
  Description of Artificial Sequence: Synthetic oligonucleotide
agcaaucaaaggcaaugcu

SEQ ID NO: 2336 - RNA, 19 nt, Artificial Sequence
  Description of Artificial Sequence: Synthetic oligonucleotide
agcauugccuuugauugcu

SEQ ID NO: 2337 - RNA, 19 nt, Artificial Sequence
  Description of Artificial Sequence: Synthetic oligonucleotide
aaucaaaggcaaugcucaa

SEQ ID NO: 2338 - RNA, 19 nt, Artificial Sequence
  Description of Artificial Sequence: Synthetic oligonucleotide
uugagcauugccuuugauu

SEQ ID NO: 2339 - RNA, 19 nt, Artificial Sequence
  Description of Artificial Sequence: Synthetic oligonucleotide
aucaaaggcaaugcucaaa

SEQ ID NO: 2340 - RNA, 19 nt, Artificial Sequence
  Description of Artificial Sequence: Synthetic oligonucleotide
uuugagcauugccuuugau

SEQ ID NO: 2341 - RNA, 19 nt, Artificial Sequence
  Description of Artificial Sequence: Synthetic oligonucleotide
ucaaaggcaaugcucaaac

SEQ ID NO: 2342 - RNA, 19 nt, Artificial Sequence
  Description of Artificial Sequence: Synthetic oligonucleotide
guuugagcauugccuuuga

SEQ ID NO: 2343 - RNA, 19 nt, Artificial Sequence
  Description of Artificial Sequence: Synthetic oligonucleotide
caaaggcaaugcucaaaca

SEQ ID NO: 2344 - RNA, 19 nt, Artificial Sequence
  Description of Artificial Sequence: Synthetic oligonucleotide
uguuugagcauugccuuug

SEQ ID NO: 2345 - RNA, 19 nt, Artificial Sequence
  Description of Artificial Sequence: Synthetic oligonucleotide
aaaggcaaugcucaaacac

SEQ ID NO: 2346 - RNA, 19 nt, Artificial Sequence
  Description of Artificial Sequence: Synthetic oligonucleotide
guguuugagcauugccuuu

SEQ ID NO: 2347 - RNA, 19 nt, Artificial Sequence
  Description of Artificial Sequence: Synthetic oligonucleotide
aaggcaaugcucaaacacc

SEQ ID NO: 2348 - RNA, 19 nt, Artificial Sequence
  Description of Artificial Sequence: Synthetic oligonucleotide
gguguuugagcauugccuu

SEQ ID NO: 2349 - RNA, 19 nt, Artificial Sequence
  Description of Artificial Sequence: Synthetic oligonucleotide
aggcaaugcucaaacaccc

SEQ ID NO: 2350 - RNA, 19 nt, Artificial Sequence
  Description of Artificial Sequence: Synthetic oligonucleotide
ggguguuugagcauugccu

SEQ ID NO: 2351 - RNA, 19 nt, Artificial Sequence
  Description of Artificial Sequence: Synthetic oligonucleotide
ucaaacacccaaguggccc

SEQ ID NO: 2352 - RNA, 19 nt, Artificial Sequence
  Description of Artificial Sequence: Synthetic oligonucleotide
gggccacuuggguguuuga

SEQ ID NO: 2353 - RNA, 19 nt, Artificial Sequence
  Description of Artificial Sequence: Synthetic oligonucleotide
caaacacccaaguggcccc

SEQ ID NO: 2354 - RNA, 19 nt, Artificial Sequence
  Description of Artificial Sequence: Synthetic oligonucleotide
ggggccacuuggguguuug

SEQ ID NO: 2355 - RNA, 19 nt, Artificial Sequence
  Description of Artificial Sequence: Synthetic oligonucleotide
aaacacccaaguggccccc

SEQ ID NO: 2356 - RNA, 19 nt, Artificial Sequence
  Description of Artificial Sequence: Synthetic oligonucleotide
gggggccacuuggguguuu

SEQ ID NO: 2357 - RNA, 19 nt, Artificial Sequence
  Description of Artificial Sequence: Synthetic oligonucleotide
aacacccaaguggccccca

SEQ ID NO: 2358 - RNA, 19 nt, Artificial Sequence
  Description of Artificial Sequence: Synthetic oligonucleotide
ugggggccacuuggguguu

SEQ ID NO: 2359 - RNA, 19 nt, Artificial Sequence
  Description of Artificial Sequence: Synthetic oligonucleotide
ccccacccucagcccgcuc

SEQ ID NO: 2360 - RNA, 19 nt, Artificial Sequence
  Description of Artificial Sequence: Synthetic oligonucleotide
gagcgggcugagggugggg

SEQ ID NO: 2361 - RNA, 19 nt, Artificial Sequence
  Description of Artificial Sequence: Synthetic oligonucleotide
acccucagcccgcuccugc

SEQ ID NO: 2362 - RNA, 19 nt, Artificial Sequence
  Description of Artificial Sequence: Synthetic oligonucleotide
gcaggagcgggcugagggu

SEQ ID NO: 2363 - RNA, 19 nt, Artificial Sequence
  Description of Artificial Sequence: Synthetic oligonucleotide
gggguucucagacugccaa

SEQ ID NO: 2364 - RNA, 19 nt, Artificial Sequence
  Description of Artificial Sequence: Synthetic oligonucleotide
uuggcagucugagaacccc

SEQ ID NO: 2365 - RNA, 19 nt, Artificial Sequence
  Description of Artificial Sequence: Synthetic oligonucleotide
guucucagacugccaaaga

SEQ ID NO: 2366 - RNA, 19 nt, Artificial Sequence
  Description of Artificial Sequence: Synthetic oligonucleotide
ucuuuggcagucugagaac

SEQ ID NO: 2367 - RNA, 19 nt, Artificial Sequence
  Description of Artificial Sequence: Synthetic oligonucleotide
ucucagacugccaaagaag

SEQ ID NO: 2368 - RNA, 19 nt, Artificial Sequence
  Description of Artificial Sequence: Synthetic oligonucleotide
cuucuuuggcagucugaga

SEQ ID NO: 2369 - RNA, 19 nt, Artificial Sequence
  Description of Artificial Sequence: Synthetic oligonucleotide
cucagacugccaaagaagc

SEQ ID NO: 2370 - RNA, 19 nt, Artificial Sequence
  Description of Artificial Sequence: Synthetic oligonucleotide
gcuucuuuggcagucugag

SEQ ID NO: 2371 - RNA, 19 nt, Artificial Sequence
  Description of Artificial Sequence: Synthetic oligonucleotide
agacugccaaagaagccuu

SEQ ID NO: 2372 - RNA, 19 nt, Artificial Sequence
  Description of Artificial Sequence: Synthetic oligonucleotide
aaggcuucuuuggcagucu

SEQ ID NO: 2373 - RNA, 19 nt, Artificial Sequence
  Description of Artificial Sequence: Synthetic oligonucleotide
agaagccuugccaucuggc

SEQ ID NO: 2374 - RNA, 19 nt, Artificial Sequence
  Description of Artificial Sequence: Synthetic oligonucleotide
gccagauggcaaggcuucu

SEQ ID NO: 2375 - RNA, 19 nt, Artificial Sequence
  Description of Artificial Sequence: Synthetic oligonucleotide
agccuugccaucuggcgcu

SEQ ID NO: 2376 - RNA, 19 nt, Artificial Sequence
  Description of Artificial Sequence: Synthetic oligonucleotide
agcgccagauggcaaggcu

SEQ ID NO: 2377 - RNA, 19 nt, Artificial Sequence
  Description of Artificial Sequence: Synthetic oligonucleotide
gccuugccaucuggcgcuc

SEQ ID NO: 2378 - RNA, 19 nt, Artificial Sequence
  Description of Artificial Sequence: Synthetic oligonucleotide
gagcgccagauggcaaggc

SEQ ID NO: 2379 - RNA, 19 nt, Artificial Sequence
  Description of Artificial Sequence: Synthetic oligonucleotide
uugccaucuggcgcuccca

SEQ ID NO: 2380 - RNA, 19 nt, Artificial Sequence
  Description of Artificial Sequence: Synthetic oligonucleotide
ugggagcgccagauggcaa

SEQ ID NO: 2381 - RNA, 19 nt, Artificial Sequence
  Description of Artificial Sequence: Synthetic oligonucleotide
ugccaucuggcgcucccau

SEQ ID NO: 2382 - RNA, 19 nt, Artificial Sequence
  Description of Artificial Sequence: Synthetic oligonucleotide
augggagcgccagauggca

SEQ ID NO: 2383 - RNA, 19 nt, Artificial Sequence
  Description of Artificial Sequence: Synthetic oligonucleotide
aucuggcgcucccauggcu

SEQ ID NO: 2384 - RNA, 19 nt, Artificial Sequence
  Description of Artificial Sequence: Synthetic oligonucleotide
agccaugggagcgccagau

SEQ ID NO: 2385 - RNA, 19 nt, Artificial Sequence
  Description of Artificial Sequence: Synthetic oligonucleotide
cuggcgcucccauggcucu

SEQ ID NO: 2386 - RNA, 19 nt, Artificial Sequence
  Description of Artificial Sequence: Synthetic oligonucleotide
agagccaugggagcgccag

SEQ ID NO: 2387 - RNA, 19 nt, Artificial Sequence
  Description of Artificial Sequence: Synthetic oligonucleotide
uggcgcucccauggcucuu

SEQ ID NO: 2388 - RNA, 19 nt, Artificial Sequence
  Description of Artificial Sequence: Synthetic oligonucleotide
aagagccaugggagcgcca

SEQ ID NO: 2389 - RNA, 19 nt, Artificial Sequence
  Description of Artificial Sequence: Synthetic oligonucleotide
ggcgcucccauggcucuug

SEQ ID NO: 2390 - RNA, 19 nt, Artificial Sequence
  Description of Artificial Sequence: Synthetic oligonucleotide
caagagccaugggagcgcc

SEQ ID NO: 2391 - RNA, 19 nt, Artificial Sequence
  Description of Artificial Sequence: Synthetic oligonucleotide
gcucccauggcucuugcaa

SEQ ID NO: 2392 - RNA, 19 nt, Artificial Sequence
  Description of Artificial Sequence: Synthetic oligonucleotide
uugcaagagccaugggagc

SEQ ID NO: 2393 - RNA, 19 nt, Artificial Sequence
  Description of Artificial Sequence: Synthetic oligonucleotide
cucccauggcucuugcaac

SEQ ID NO: 2394 - RNA, 19 nt, Artificial Sequence
  Description of Artificial Sequence: Synthetic oligonucleotide
guugcaagagccaugggag

SEQ ID NO: 2395 - RNA, 19 nt, Artificial Sequence
  Description of Artificial Sequence: Synthetic oligonucleotide
ucccauggcucuugcaaca

SEQ ID NO: 2396 - RNA, 19 nt, Artificial Sequence
  Description of Artificial Sequence: Synthetic oligonucleotide
uguugcaagagccauggga

SEQ ID NO: 2397 - RNA, 19 nt, Artificial Sequence
  Description of Artificial Sequence: Synthetic oligonucleotide
cccauggcucuugcaacau

SEQ ID NO: 2398 - RNA, 19 nt, Artificial Sequence
  Description of Artificial Sequence: Synthetic oligonucleotide
auguugcaagagccauggg

SEQ ID NO: 2399 - RNA, 19 nt, Artificial Sequence
  Description of Artificial Sequence: Synthetic oligonucleotide
ccauggcucuugcaacauc

SEQ ID NO: 2400 - RNA, 19 nt, Artificial Sequence
  Description of Artificial Sequence: Synthetic oligonucleotide
gauguugcaagagccaugg

SEQ ID NO: 2401 - RNA, 19 nt, Artificial Sequence
  Description of Artificial Sequence: Synthetic oligonucleotide
cauggcucuugcaacaucu

SEQ ID NO: 2402 - RNA, 19 nt, Artificial Sequence
  Description of Artificial Sequence: Synthetic oligonucleotide
agauguugcaagagccaug

SEQ ID NO: 2403 - RNA, 19 nt, Artificial Sequence
  Description of Artificial Sequence: Synthetic oligonucleotide
ugcaacaucuccccuucgu

SEQ ID NO: 2404 - RNA, 19 nt, Artificial Sequence
  Description of Artificial Sequence: Synthetic oligonucleotide
acgaaggggagauguugca

SEQ ID NO: 2405 - RNA, 19 nt, Artificial Sequence
  Description of Artificial Sequence: Synthetic oligonucleotide
gcaacaucuccccuucguu

SEQ ID NO: 2406 - RNA, 19 nt, Artificial Sequence
  Description of Artificial Sequence: Synthetic oligonucleotide
aacgaaggggagauguugc

SEQ ID NO: 2407 - RNA, 19 nt, Artificial Sequence
  Description of Artificial Sequence: Synthetic oligonucleotide
caacaucuccccuucguuu

SEQ ID NO: 2408 - RNA, 19 nt, Artificial Sequence
  Description of Artificial Sequence: Synthetic oligonucleotide
aaacgaaggggagauguug

SEQ ID NO: 2409 - RNA, 19 nt, Artificial Sequence
  Description of Artificial Sequence: Synthetic oligonucleotide
aacaucuccccuucguuuu

SEQ ID NO: 2410 - RNA, 19 nt, Artificial Sequence
  Description of Artificial Sequence: Synthetic oligonucleotide
aaaacgaaggggagauguu

SEQ ID NO: 2411 - RNA, 19 nt, Artificial Sequence
  Description of Artificial Sequence: Synthetic oligonucleotide
acaucuccccuucguuuuu

SEQ ID NO: 2412 - RNA, 19 nt, Artificial Sequence
  Description of Artificial Sequence: Synthetic oligonucleotide
aaaaacgaaggggagaugu

SEQ ID NO: 2413 - RNA, 19 nt, Artificial Sequence
  Description of Artificial Sequence: Synthetic oligonucleotide
caucuccccuucguuuuug

SEQ ID NO: 2414 - RNA, 19 nt, Artificial Sequence
  Description of Artificial Sequence: Synthetic oligonucleotide
caaaaacgaaggggagaug

SEQ ID NO: 2415 - RNA, 19 nt, Artificial Sequence
  Description of Artificial Sequence: Synthetic oligonucleotide
aucuccccuucguuuuuga

SEQ ID NO: 2416 - RNA, 19 nt, Artificial Sequence
  Description of Artificial Sequence: Synthetic oligonucleotide
ucaaaaacgaaggggagau

SEQ ID NO: 2417 - RNA, 19 nt, Artificial Sequence
  Description of Artificial Sequence: Synthetic oligonucleotide
ucuccccuucguuuuugag

SEQ ID NO: 2418 - RNA, 19 nt, Artificial Sequence
  Description of Artificial Sequence: Synthetic oligonucleotide
cucaaaaacgaaggggaga

SEQ ID NO: 2419 - RNA, 19 nt, Artificial Sequence
  Description of Artificial Sequence: Synthetic oligonucleotide
cuccccuucguuuuugagg

SEQ ID NO: 2420 - RNA, 19 nt, Artificial Sequence
  Description of Artificial Sequence: Synthetic oligonucleotide
ccucaaaaacgaaggggag

SEQ ID NO: 2421 - RNA, 19 nt, Artificial Sequence
  Description of Artificial Sequence: Synthetic oligonucleotide
cccuucguuuuugaggggg

SEQ ID NO: 2422 - RNA, 19 nt, Artificial Sequence
  Description of Artificial Sequence: Synthetic oligonucleotide
cccccucaaaaacgaaggg

SEQ ID NO: 2423 - RNA, 19 nt, Artificial Sequence
  Description of Artificial Sequence: Synthetic oligonucleotide
ccuucguuuuugagggggu

SEQ ID NO: 2424 - RNA, 19 nt, Artificial Sequence
  Description of Artificial Sequence: Synthetic oligonucleotide
acccccucaaaaacgaagg

SEQ ID NO: 2425 - RNA, 19 nt, Artificial Sequence
  Description of Artificial Sequence: Synthetic oligonucleotide
cuucguuuuugaggggguc

SEQ ID NO: 2426 - RNA, 19 nt, Artificial Sequence
  Description of Artificial Sequence: Synthetic oligonucleotide
gacccccucaaaaacgaag

SEQ ID NO: 2427 - RNA, 19 nt, Artificial Sequence
  Description of Artificial Sequence: Synthetic oligonucleotide
uucguuuuugaggggguca

SEQ ID NO: 2428 - RNA, 19 nt, Artificial Sequence
  Description of Artificial Sequence: Synthetic oligonucleotide
ugacccccucaaaaacgaa

SEQ ID NO: 2429 - RNA, 19 nt, Artificial Sequence
  Description of Artificial Sequence: Synthetic oligonucleotide
ucguuuuugagggggucau

SEQ ID NO: 2430 - RNA, 19 nt, Artificial Sequence
  Description of Artificial Sequence: Synthetic oligonucleotide
augacccccucaaaaacga

SEQ ID NO: 2431 - RNA, 19 nt, Artificial Sequence
  Description of Artificial Sequence: Synthetic oligonucleotide
cguuuuugagggggucaug

SEQ ID NO: 2432 - RNA, 19 nt, Artificial Sequence
  Description of Artificial Sequence: Synthetic oligonucleotide
caugacccccucaaaaacg

SEQ ID NO: 2433 - RNA, 19 nt, Artificial Sequence
  Description of Artificial Sequence: Synthetic oligonucleotide
guuuuugagggggucaugc

SEQ ID NO: 2434 - RNA, 19 nt, Artificial Sequence
  Description of Artificial Sequence: Synthetic oligonucleotide
gcaugacccccucaaaaac

SEQ ID NO: 2435 - RNA, 19 nt, Artificial Sequence
  Description of Artificial Sequence: Synthetic oligonucleotide
uuuuugagggggucaugcc

SEQ ID NO: 2436 - RNA, 19 nt, Artificial Sequence
  Description of Artificial Sequence: Synthetic oligonucleotide
ggcaugacccccucaaaaa

SEQ ID NO: 2437 - RNA, 19 nt, Artificial Sequence
  Description of Artificial Sequence: Synthetic oligonucleotide
uuuugagggggucaugccg

SEQ ID NO: 2438 - RNA, 19 nt, Artificial Sequence
  Description of Artificial Sequence: Synthetic oligonucleotide
cggcaugacccccucaaaa

SEQ ID NO: 2439 - RNA, 19 nt, Artificial Sequence
  Description of Artificial Sequence: Synthetic oligonucleotide
uuugagggggucaugccgg

SEQ ID NO: 2440 - RNA, 19 nt, Artificial Sequence
  Description of Artificial Sequence: Synthetic oligonucleotide
ccggcaugacccccucaaa

SEQ ID NO: 2441 - RNA, 19 nt, Artificial Sequence
  Description of Artificial Sequence: Synthetic oligonucleotide
agggggucaugccggggga

SEQ ID NO: 2442 - RNA, 19 nt, Artificial Sequence
  Description of Artificial Sequence: Synthetic oligonucleotide
ucccccggcaugacccccu

SEQ ID NO: 2443 - RNA, 19 nt, Artificial Sequence
  Description of Artificial Sequence: Synthetic oligonucleotide
augccgggggagccaccag

SEQ ID NO: 2444 - RNA, 19 nt, Artificial Sequence
  Description of Artificial Sequence: Synthetic oligonucleotide
cugguggcucccccggcau

SEQ ID NO: 2445 - RNA, 19 nt, Artificial Sequence
  Description of Artificial Sequence: Synthetic oligonucleotide
cccucacuggguucggagg

SEQ ID NO: 2446 - RNA, 19 nt, Artificial Sequence
  Description of Artificial Sequence: Synthetic oligonucleotide
ccuccgaacccagugaggg

SEQ ID NO: 2447 - RNA, 19 nt, Artificial Sequence
  Description of Artificial Sequence: Synthetic oligonucleotide
ccucacuggguucggagga

SEQ ID NO: 2448 - RNA, 19 nt, Artificial Sequence
  Description of Artificial Sequence: Synthetic oligonucleotide
uccuccgaacccagugagg

SEQ ID NO: 2449 - RNA, 19 nt, Artificial Sequence
  Description of Artificial Sequence: Synthetic oligonucleotide
cucacuggguucggaggag

SEQ ID NO: 2450 - RNA, 19 nt, Artificial Sequence
  Description of Artificial Sequence: Synthetic oligonucleotide
cuccuccgaacccagugag

SEQ ID NO: 2451 - RNA, 19 nt, Artificial Sequence
  Description of Artificial Sequence: Synthetic oligonucleotide
ucacuggguucggaggaga

SEQ ID NO: 2452 - RNA, 19 nt, Artificial Sequence
  Description of Artificial Sequence: Synthetic oligonucleotide
ucuccuccgaacccaguga

SEQ ID NO: 2453 - RNA, 19 nt, Artificial Sequence
  Description of Artificial Sequence: Synthetic oligonucleotide
cuggguucggaggagaguc

SEQ ID NO: 2454 - RNA, 19 nt, Artificial Sequence
  Description of Artificial Sequence: Synthetic oligonucleotide
gacucuccuccgaacccag

SEQ ID NO: 2455 - RNA, 19 nt, Artificial Sequence
  Description of Artificial Sequence: Synthetic oligonucleotide
uggguucggaggagaguca

SEQ ID NO: 2456 - RNA, 19 nt, Artificial Sequence
  Description of Artificial Sequence: Synthetic oligonucleotide
ugacucuccuccgaaccca

SEQ ID NO: 2457 - RNA, 19 nt, Artificial Sequence
  Description of Artificial Sequence: Synthetic oligonucleotide
ggguucggaggagagucag

SEQ ID NO: 2458 - RNA, 19 nt, Artificial Sequence
  Description of Artificial Sequence: Synthetic oligonucleotide
cugacucuccuccgaaccc

SEQ ID NO: 2459 - RNA, 19 nt, Artificial Sequence
  Description of Artificial Sequence: Synthetic oligonucleotide
gucaggaagggccacgaca

SEQ ID NO: 2460 - RNA, 19 nt, Artificial Sequence
  Description of Artificial Sequence: Synthetic oligonucleotide
ugucguggcccuuccugac

SEQ ID NO: 2461 - RNA, 19 nt, Artificial Sequence
  Description of Artificial Sequence: Synthetic oligonucleotide
ucaggaagggccacgacaa

SEQ ID NO: 2462 - RNA, 19 nt, Artificial Sequence
  Description of Artificial Sequence: Synthetic oligonucleotide
uugucguggcccuuccuga

SEQ ID NO: 2463 - RNA, 19 nt, Artificial Sequence
  Description of Artificial Sequence: Synthetic oligonucleotide
aggaagggccacgacaaag

SEQ ID NO: 2464 - RNA, 19 nt, Artificial Sequence
  Description of Artificial Sequence: Synthetic oligonucleotide
cuuugucguggcccuuccu

SEQ ID NO: 2465 - RNA, 19 nt, Artificial Sequence
  Description of Artificial Sequence: Synthetic oligonucleotide
ggaagggccacgacaaagc

SEQ ID NO: 2466 - RNA, 19 nt, Artificial Sequence
  Description of Artificial Sequence: Synthetic oligonucleotide
gcuuugucguggcccuucc

SEQ ID NO: 2467 - RNA, 19 nt, Artificial Sequence
  Description of Artificial Sequence: Synthetic oligonucleotide
gaagggccacgacaaagca

SEQ ID NO: 2468 - RNA, 19 nt, Artificial Sequence
  Description of Artificial Sequence: Synthetic oligonucleotide
ugcuuugucguggcccuuc

SEQ ID NO: 2469 - RNA, 19 nt, Artificial Sequence
  Description of Artificial Sequence: Synthetic oligonucleotide
aagggccacgacaaagcag

SEQ ID NO: 2470 - RNA, 19 nt, Artificial Sequence
  Description of Artificial Sequence: Synthetic oligonucleotide
cugcuuugucguggcccuu

SEQ ID NO: 2471 - RNA, 19 nt, Artificial Sequence
  Description of Artificial Sequence: Synthetic oligonucleotide
agggccacgacaaagcaga

SEQ ID NO: 2472 - RNA, 19 nt, Artificial Sequence
  Description of Artificial Sequence: Synthetic oligonucleotide
ucugcuuugucguggcccu

SEQ ID NO: 2473 - RNA, 19 nt, Artificial Sequence
  Description of Artificial Sequence: Synthetic oligonucleotide
gggccacgacaaagcagaa

SEQ ID NO: 2474 - RNA, 19 nt, Artificial Sequence
  Description of Artificial Sequence: Synthetic oligonucleotide
uucugcuuugucguggccc

SEQ ID NO: 2475 - RNA, 19 nt, Artificial Sequence
  Description of Artificial Sequence: Synthetic oligonucleotide
gccacgacaaagcagaaac

SEQ ID NO: 2476 - RNA, 19 nt, Artificial Sequence
  Description of Artificial Sequence: Synthetic oligonucleotide
guuucugcuuugucguggc

SEQ ID NO: 2477 - RNA, 19 nt, Artificial Sequence
  Description of Artificial Sequence: Synthetic oligonucleotide
cgacaaagcagaaacaucg

SEQ ID NO: 2478 - RNA, 19 nt, Artificial Sequence
  Description of Artificial Sequence: Synthetic oligonucleotide
cgauguuucugcuuugucg

SEQ ID NO: 2479 - RNA, 19 nt, Artificial Sequence
  Description of Artificial Sequence: Synthetic oligonucleotide
caaagcagaaacaucggau

SEQ ID NO: 2480 - RNA, 19 nt, Artificial Sequence
  Description of Artificial Sequence: Synthetic oligonucleotide
auccgauguuucugcuuug

SEQ ID NO: 2481 - RNA, 19 nt, Artificial Sequence
  Description of Artificial Sequence: Synthetic oligonucleotide
aagcagaaacaucggauuu

SEQ ID NO: 2482 - RNA, 19 nt, Artificial Sequence
  Description of Artificial Sequence: Synthetic oligonucleotide
aaauccgauguuucugcuu

SEQ ID NO: 2483 - RNA, 19 nt, Artificial Sequence
  Description of Artificial Sequence: Synthetic oligonucleotide
gcagaaacaucggauuugg

SEQ ID NO: 2484 - RNA, 19 nt, Artificial Sequence
  Description of Artificial Sequence: Synthetic oligonucleotide
ccaaauccgauguuucugc

SEQ ID NO: 2485 - RNA, 19 nt, Artificial Sequence
  Description of Artificial Sequence: Synthetic oligonucleotide
aaacaucggauuuggggaa

SEQ ID NO: 2486 - RNA, 19 nt, Artificial Sequence
  Description of Artificial Sequence: Synthetic oligonucleotide
uuccccaaauccgauguuu

SEQ ID NO: 2487 - RNA, 19 nt, Artificial Sequence
  Description of Artificial Sequence: Synthetic oligonucleotide
caucggauuuggggaacgc

SEQ ID NO: 2488 - RNA, 19 nt, Artificial Sequence
  Description of Artificial Sequence: Synthetic oligonucleotide
gcguuccccaaauccgaug

SEQ ID NO: 2489 - RNA, 19 nt, Artificial Sequence
  Description of Artificial Sequence: Synthetic oligonucleotide
ucggauuuggggaacgcgu

SEQ ID NO: 2490 - RNA, 19 nt, Artificial Sequence
  Description of Artificial Sequence: Synthetic oligonucleotide
acgcguuccccaaauccga

SEQ ID NO: 2491 - RNA, 19 nt, Artificial Sequence
  Description of Artificial Sequence: Synthetic oligonucleotide
cggauuuggggaacgcgug

SEQ ID NO: 2492 - RNA, 19 nt, Artificial Sequence
  Description of Artificial Sequence: Synthetic oligonucleotide
cacgcguuccccaaauccg

SEQ ID NO: 2493 - RNA, 19 nt, Artificial Sequence
  Description of Artificial Sequence: Synthetic oligonucleotide
ggauuuggggaacgcgugu

SEQ ID NO: 2494 - RNA, 19 nt, Artificial Sequence
  Description of Artificial Sequence: Synthetic oligonucleotide
acacgcguuccccaaaucc

SEQ ID NO: 2495 - RNA, 19 nt, Artificial Sequence
  Description of Artificial Sequence: Synthetic oligonucleotide
gauuuggggaacgcguguc

SEQ ID NO: 2496 - RNA, 19 nt, Artificial Sequence
  Description of Artificial Sequence: Synthetic oligonucleotide
gacacgcguuccccaaauc

SEQ ID NO: 2497 - RNA, 19 nt, Artificial Sequence
  Description of Artificial Sequence: Synthetic oligonucleotide
auuuggggaacgcguguca

SEQ ID NO: 2498 - RNA, 19 nt, Artificial Sequence
  Description of Artificial Sequence: Synthetic oligonucleotide
ugacacgcguuccccaaau

SEQ ID NO: 2499 - RNA, 19 nt, Artificial Sequence
  Description of Artificial Sequence: Synthetic oligonucleotide
gggaacgcgugucaauccc

SEQ ID NO: 2500 - RNA, 19 nt, Artificial Sequence
  Description of Artificial Sequence: Synthetic oligonucleotide
gggauugacacgcguuccc

SEQ ID NO: 2501 - RNA, 19 nt, Artificial Sequence
  Description of Artificial Sequence: Synthetic oligonucleotide
ggaacgcgugucaaucccu

SEQ ID NO: 2502 - RNA, 19 nt, Artificial Sequence
  Description of Artificial Sequence: Synthetic oligonucleotide
agggauugacacgcguucc

SEQ ID NO: 2503 - RNA, 19 nt, Artificial Sequence
  Description of Artificial Sequence: Synthetic oligonucleotide
gaacgcgugucaaucccuu

SEQ ID NO: 2504 - RNA, 19 nt, Artificial Sequence
  Description of Artificial Sequence: Synthetic oligonucleotide
aagggauugacacgcguuc

SEQ ID NO: 2505 - RNA, 19 nt, Artificial Sequence
  Description of Artificial Sequence: Synthetic oligonucleotide
aacgcgugucaaucccuug

SEQ ID NO: 2506 - RNA, 19 nt, Artificial Sequence
  Description of Artificial Sequence: Synthetic oligonucleotide
caagggauugacacgcguu

SEQ ID NO: 2507 - RNA, 19 nt, Artificial Sequence
  Description of Artificial Sequence: Synthetic oligonucleotide
acgcgugucaaucccuugu

SEQ ID NO: 2508 - RNA, 19 nt, Artificial Sequence
  Description of Artificial Sequence: Synthetic oligonucleotide
acaagggauugacacgcgu

SEQ ID NO: 2509 - RNA, 19 nt, Artificial Sequence
  Description of Artificial Sequence: Synthetic oligonucleotide
cgcgugucaaucccuugug

SEQ ID NO: 2510 - RNA, 19 nt, Artificial Sequence
  Description of Artificial Sequence: Synthetic oligonucleotide
cacaagggauugacacgcg

SEQ ID NO: 2511 - RNA, 19 nt, Artificial Sequence
  Description of Artificial Sequence: Synthetic oligonucleotide
gcgugucaaucccuugugc

SEQ ID NO: 2512 - RNA, 19 nt, Artificial Sequence
  Description of Artificial Sequence: Synthetic oligonucleotide
gcacaagggauugacacgc

SEQ ID NO: 2513 - RNA, 19 nt, Artificial Sequence
  Description of Artificial Sequence: Synthetic oligonucleotide
cgugucaaucccuugugcc

SEQ ID NO: 2514 - RNA, 19 nt, Artificial Sequence
  Description of Artificial Sequence: Synthetic oligonucleotide
ggcacaagggauugacacg

SEQ ID NO: 2515 - RNA, 19 nt, Artificial Sequence
  Description of Artificial Sequence: Synthetic oligonucleotide
gugucaaucccuugugccg

SEQ ID NO: 2516 - RNA, 19 nt, Artificial Sequence
  Description of Artificial Sequence: Synthetic oligonucleotide
cggcacaagggauugacac

SEQ ID NO: 2517 - RNA, 19 nt, Artificial Sequence
  Description of Artificial Sequence: Synthetic oligonucleotide
ugucaaucccuugugccgc

SEQ ID NO: 2518 - RNA, 19 nt, Artificial Sequence
  Description of Artificial Sequence: Synthetic oligonucleotide
gcggcacaagggauugaca

SEQ ID NO: 2519 - RNA, 19 nt, Artificial Sequence
  Description of Artificial Sequence: Synthetic oligonucleotide
gucaaucccuugugccgca

SEQ ID NO: 2520 - RNA, 19 nt, Artificial Sequence
  Description of Artificial Sequence: Synthetic oligonucleotide
ugcggcacaagggauugac

SEQ ID NO: 2521 - RNA, 19 nt, Artificial Sequence
  Description of Artificial Sequence: Synthetic oligonucleotide
cugggcgggagagacuguu

SEQ ID NO: 2522 - RNA, 19 nt, Artificial Sequence
  Description of Artificial Sequence: Synthetic oligonucleotide
aacagucucucccgcccag

SEQ ID NO: 2523 - RNA, 19 nt, Artificial Sequence
  Description of Artificial Sequence: Synthetic oligonucleotide
ggcgggagagacuguucug

SEQ ID NO: 2524 - RNA, 19 nt, Artificial Sequence
  Description of Artificial Sequence: Synthetic oligonucleotide
cagaacagucucucccgcc

SEQ ID NO: 2525 - RNA, 19 nt, Artificial Sequence
  Description of Artificial Sequence: Synthetic oligonucleotide
gcgggagagacuguucugu

SEQ ID NO: 2526 - RNA, 19 nt, Artificial Sequence
  Description of Artificial Sequence: Synthetic oligonucleotide
acagaacagucucucccgc

SEQ ID NO: 2527 - RNA, 19 nt, Artificial Sequence
  Description of Artificial Sequence: Synthetic oligonucleotide
ggagagacuguucuguucc

SEQ ID NO: 2528 - RNA, 19 nt, Artificial Sequence
  Description of Artificial Sequence: Synthetic oligonucleotide
ggaacagaacagucucucc

SEQ ID NO: 2529 - RNA, 19 nt, Artificial Sequence
  Description of Artificial Sequence: Synthetic oligonucleotide
cuguucuguuccuugugua

SEQ ID NO: 2530 - RNA, 19 nt, Artificial Sequence
  Description of Artificial Sequence: Synthetic oligonucleotide
uacacaaggaacagaacag

SEQ ID NO: 2531 - RNA, 19 nt, Artificial Sequence
  Description of Artificial Sequence: Synthetic oligonucleotide
uguucuguuccuuguguaa

SEQ ID NO: 2532 - RNA, 19 nt, Artificial Sequence
  Description of Artificial Sequence: Synthetic oligonucleotide
uuacacaaggaacagaaca

SEQ ID NO: 2533 - RNA, 19 nt, Artificial Sequence
  Description of Artificial Sequence: Synthetic oligonucleotide
ucuguuccuuguguaacug

SEQ ID NO: 2534 - RNA, 19 nt, Artificial Sequence
  Description of Artificial Sequence: Synthetic oligonucleotide
caguuacacaaggaacaga

SEQ ID NO: 2535 - RNA, 19 nt, Artificial Sequence
  Description of Artificial Sequence: Synthetic oligonucleotide
uguguugcugaaagacuac

SEQ ID NO: 2536 - RNA, 19 nt, Artificial Sequence
  Description of Artificial Sequence: Synthetic oligonucleotide
guagucuuucagcaacaca

SEQ ID NO: 2537 - RNA, 19 nt, Artificial Sequence
  Description of Artificial Sequence: Synthetic oligonucleotide
gcugaaagacuaccucguu

SEQ ID NO: 2538 - RNA, 19 nt, Artificial Sequence
  Description of Artificial Sequence: Synthetic oligonucleotide
aacgagguagucuuucagc

SEQ ID NO: 2539 - RNA, 19 nt, Artificial Sequence
  Description of Artificial Sequence: Synthetic oligonucleotide
cugaaagacuaccucguuc

SEQ ID NO: 2540 - RNA, 19 nt, Artificial Sequence
  Description of Artificial Sequence: Synthetic oligonucleotide
gaacgagguagucuuucag

SEQ ID NO: 2541 - RNA, 19 nt, Artificial Sequence
  Description of Artificial Sequence: Synthetic oligonucleotide
ugaaagacuaccucguucu

SEQ ID NO: 2542 - RNA, 19 nt, Artificial Sequence
  Description of Artificial Sequence: Synthetic oligonucleotide
agaacgagguagucuuuca

SEQ ID NO: 2543 - RNA, 19 nt, Artificial Sequence
  Description of Artificial Sequence: Synthetic oligonucleotide
gaaagacuaccucguucuu

SEQ ID NO: 2544 - RNA, 19 nt, Artificial Sequence
  Description of Artificial Sequence: Synthetic oligonucleotide
aagaacgagguagucuuuc

SEQ ID NO: 2545 - RNA, 19 nt, Artificial Sequence
  Description of Artificial Sequence: Synthetic oligonucleotide
aagacuaccucguucuugu

SEQ ID NO: 2546 - RNA, 19 nt, Artificial Sequence
  Description of Artificial Sequence: Synthetic oligonucleotide
acaagaacgagguagucuu

SEQ ID NO: 2547 - RNA, 19 nt, Artificial Sequence
  Description of Artificial Sequence: Synthetic oligonucleotide
cuaccucguucuugucuug

SEQ ID NO: 2548 - RNA, 19 nt, Artificial Sequence
  Description of Artificial Sequence: Synthetic oligonucleotide
caagacaagaacgagguag

SEQ ID NO: 2549 - RNA, 19 nt, Artificial Sequence
  Description of Artificial Sequence: Synthetic oligonucleotide
uaccucguucuugucuuga

SEQ ID NO: 2550 - RNA, 19 nt, Artificial Sequence
  Description of Artificial Sequence: Synthetic oligonucleotide
ucaagacaagaacgaggua

SEQ ID NO: 2551 - RNA, 19 nt, Artificial Sequence
  Description of Artificial Sequence: Synthetic oligonucleotide
accucguucuugucuugau

SEQ ID NO: 2552 - RNA, 19 nt, Artificial Sequence
  Description of Artificial Sequence: Synthetic oligonucleotide
aucaagacaagaacgaggu

SEQ ID NO: 2553 - RNA, 19 nt, Artificial Sequence
  Description of Artificial Sequence: Synthetic oligonucleotide
ccucguucuugucuugaug

SEQ ID NO: 2554 - RNA, 19 nt, Artificial Sequence
  Description of Artificial Sequence: Synthetic oligonucleotide
caucaagacaagaacgagg

SEQ ID NO: 2555 - RNA, 19 nt, Artificial Sequence
  Description of Artificial Sequence: Synthetic oligonucleotide
cucguucuugucuugaugu

SEQ ID NO: 2556 - RNA, 19 nt, Artificial Sequence
  Description of Artificial Sequence: Synthetic oligonucleotide
acaucaagacaagaacgag

SEQ ID NO: 2557 - RNA, 19 nt, Artificial Sequence
  Description of Artificial Sequence: Synthetic oligonucleotide
ucguucuugucuugaugug

SEQ ID NO: 2558 - RNA, 19 nt, Artificial Sequence
  Description of Artificial Sequence: Synthetic oligonucleotide
cacaucaagacaagaacga

SEQ ID NO: 2559 - RNA, 19 nt, Artificial Sequence
  Description of Artificial Sequence: Synthetic oligonucleotide
uugucuugaugugucaccg

SEQ ID NO: 2560 - RNA, 19 nt, Artificial Sequence
  Description of Artificial Sequence: Synthetic oligonucleotide
cggugacacaucaagacaa

SEQ ID NO: 2561 - RNA, 19 nt, Artificial Sequence
  Description of Artificial Sequence: Synthetic oligonucleotide
ugucuugaugugucaccgg

SEQ ID NO: 2562 - RNA, 19 nt, Artificial Sequence
  Description of Artificial Sequence: Synthetic oligonucleotide
ccggugacacaucaagaca

SEQ ID NO: 2563 - RNA, 19 nt, Artificial Sequence
  Description of Artificial Sequence: Synthetic oligonucleotide
ucuugaugugucaccgggg

SEQ ID NO: 2564 - RNA, 19 nt, Artificial Sequence
  Description of Artificial Sequence: Synthetic oligonucleotide
ccccggugacacaucaaga

SEQ ID NO: 2565 - RNA, 19 nt, Artificial Sequence
  Description of Artificial Sequence: Synthetic oligonucleotide
cuugaugugucaccggggc

SEQ ID NO: 2566 - RNA, 19 nt, Artificial Sequence
  Description of Artificial Sequence: Synthetic oligonucleotide
gccccggugacacaucaag

SEQ ID NO: 2567 - RNA, 19 nt, Artificial Sequence
  Description of Artificial Sequence: Synthetic oligonucleotide
uugaugugucaccggggca

SEQ ID NO: 2568 - RNA, 19 nt, Artificial Sequence
  Description of Artificial Sequence: Synthetic oligonucleotide
ugccccggugacacaucaa

SEQ ID NO: 2569 - RNA, 19 nt, Artificial Sequence
  Description of Artificial Sequence: Synthetic oligonucleotide
gugucaccggggcaacugc

SEQ ID NO: 2570 - RNA, 19 nt, Artificial Sequence
  Description of Artificial Sequence: Synthetic oligonucleotide
gcaguugccccggugacac

SEQ ID NO: 2571 - RNA, 19 nt, Artificial Sequence
  Description of Artificial Sequence: Synthetic oligonucleotide
ucaccggggcaacugccug

SEQ ID NO: 2572 - RNA, 19 nt, Artificial Sequence
  Description of Artificial Sequence: Synthetic oligonucleotide
caggcaguugccccgguga

SEQ ID NO: 2573 - RNA, 19 nt, Artificial Sequence
  Description of Artificial Sequence: Synthetic oligonucleotide
caacugccugggggcgggg

SEQ ID NO: 2574 - RNA, 19 nt, Artificial Sequence
  Description of Artificial Sequence: Synthetic oligonucleotide
ccccgcccccaggcaguug

SEQ ID NO: 2575 - RNA, 19 nt, Artificial Sequence
  Description of Artificial Sequence: Synthetic oligonucleotide
agcggcuccccauuuuaua

SEQ ID NO: 2576 - RNA, 19 nt, Artificial Sequence
  Description of Artificial Sequence: Synthetic oligonucleotide
uauaaaauggggagccgcu

SEQ ID NO: 2577 - RNA, 19 nt, Artificial Sequence
  Description of Artificial Sequence: Synthetic oligonucleotide
gcggcuccccauuuuauac

SEQ ID NO: 2578 - RNA, 19 nt, Artificial Sequence
  Description of Artificial Sequence: Synthetic oligonucleotide
guauaaaauggggagccgc

SEQ ID NO: 2579 - RNA, 19 nt, Artificial Sequence
  Description of Artificial Sequence: Synthetic oligonucleotide
cggcuccccauuuuauacc

SEQ ID NO: 2580 - RNA, 19 nt, Artificial Sequence
  Description of Artificial Sequence: Synthetic oligonucleotide
gguauaaaauggggagccg

SEQ ID NO: 2581 - RNA, 19 nt, Artificial Sequence
  Description of Artificial Sequence: Synthetic oligonucleotide
ggcuccccauuuuauacca

SEQ ID NO: 2582 - RNA, 19 nt, Artificial Sequence
  Description of Artificial Sequence: Synthetic oligonucleotide
ugguauaaaauggggagcc

SEQ ID NO: 2583 - RNA, 19 nt, Artificial Sequence
  Description of Artificial Sequence: Synthetic oligonucleotide
gcuccccauuuuauaccaa

SEQ ID NO: 2584 - RNA, 19 nt, Artificial Sequence
  Description of Artificial Sequence: Synthetic oligonucleotide
uugguauaaaauggggagc

SEQ ID NO: 2585 - RNA, 19 nt, Artificial Sequence
  Description of Artificial Sequence: Synthetic oligonucleotide
cuccccauuuuauaccaaa

SEQ ID NO: 2586 - RNA, 19 nt, Artificial Sequence
  Description of Artificial Sequence: Synthetic oligonucleotide
uuugguauaaaauggggag

SEQ ID NO: 2587 - RNA, 19 nt, Artificial Sequence
  Description of Artificial Sequence: Synthetic oligonucleotide
uccccauuuuauaccaaag

SEQ ID NO: 2588 - RNA, 19 nt, Artificial Sequence
  Description of Artificial Sequence: Synthetic oligonucleotide
cuuugguauaaaaugggga

SEQ ID NO: 2589 - RNA, 19 nt, Artificial Sequence
  Description of Artificial Sequence: Synthetic oligonucleotide
cauuuuauaccaaaggugc

SEQ ID NO: 2590 - RNA, 19 nt, Artificial Sequence
  Description of Artificial Sequence: Synthetic oligonucleotide
gcaccuuugguauaaaaug

SEQ ID NO: 2591 - RNA, 19 nt, Artificial Sequence
  Description of Artificial Sequence: Synthetic oligonucleotide
uuauaccaaaggugcuaca

SEQ ID NO: 2592 - RNA, 19 nt, Artificial Sequence
  Description of Artificial Sequence: Synthetic oligonucleotide
uguagcaccuuugguauaa

SEQ ID NO: 2593 - RNA, 19 nt, Artificial Sequence
  Description of Artificial Sequence: Synthetic oligonucleotide
uauaccaaaggugcuacau

SEQ ID NO: 2594 - RNA, 19 nt, Artificial Sequence
  Description of Artificial Sequence: Synthetic oligonucleotide
auguagcaccuuugguaua

SEQ ID NO: 2595 - RNA, 19 nt, Artificial Sequence
  Description of Artificial Sequence: Synthetic oligonucleotide
auaccaaaggugcuacauc

SEQ ID NO: 2596 - RNA, 19 nt, Artificial Sequence
  Description of Artificial Sequence: Synthetic oligonucleotide
gauguagcaccuuugguau

SEQ ID NO: 2597 - RNA, 19 nt, Artificial Sequence
  Description of Artificial Sequence: Synthetic oligonucleotide
uaccaaaggugcuacaucu

SEQ ID NO: 2598 - RNA, 19 nt, Artificial Sequence
  Description of Artificial Sequence: Synthetic oligonucleotide
agauguagcaccuuuggua

SEQ ID NO: 2599 - RNA, 19 nt, Artificial Sequence
  Description of Artificial Sequence: Synthetic oligonucleotide
accaaaggugcuacaucua

SEQ ID NO: 2600 - RNA, 19 nt, Artificial Sequence
  Description of Artificial Sequence: Synthetic oligonucleotide
uagauguagcaccuuuggu

SEQ ID NO: 2601 - RNA, 19 nt, Artificial Sequence
  Description of Artificial Sequence: Synthetic oligonucleotide
ccaaaggugcuacaucuau

SEQ ID NO: 2602 - RNA, 19 nt, Artificial Sequence
  Description of Artificial Sequence: Synthetic oligonucleotide
auagauguagcaccuuugg

SEQ ID NO: 2603 - RNA, 19 nt, Artificial Sequence
  Description of Artificial Sequence: Synthetic oligonucleotide
guggggagggaaucacugg

SEQ ID NO: 2604 - RNA, 19 nt, Artificial Sequence
  Description of Artificial Sequence: Synthetic oligonucleotide
ccagugauucccuccccac

SEQ ID NO: 2605 - RNA, 19 nt, Artificial Sequence
  Description of Artificial Sequence: Synthetic oligonucleotide
uggggagggaaucacuggu

SEQ ID NO: 2606 - RNA, 19 nt, Artificial Sequence
  Description of Artificial Sequence: Synthetic oligonucleotide
accagugauucccucccca

SEQ ID NO: 2607 - RNA, 19 nt, Artificial Sequence
  Description of Artificial Sequence: Synthetic oligonucleotide
ggggagggaaucacuggug

SEQ ID NO: 2608 - RNA, 19 nt, Artificial Sequence
  Description of Artificial Sequence: Synthetic oligonucleotide
caccagugauucccucccc

SEQ ID NO: 2609 - RNA, 19 nt, Artificial Sequence
  Description of Artificial Sequence: Synthetic oligonucleotide
aucacuggugcuauagaaa

SEQ ID NO: 2610 - RNA, 19 nt, Artificial Sequence
  Description of Artificial Sequence: Synthetic oligonucleotide
uuucuauagcaccagugau

SEQ ID NO: 2611 - RNA, 19 nt, Artificial Sequence
  Description of Artificial Sequence: Synthetic oligonucleotide
ucacuggugcuauagaaau

SEQ ID NO: 2612 - RNA, 19 nt, Artificial Sequence
  Description of Artificial Sequence: Synthetic oligonucleotide
auuucuauagcaccaguga

SEQ ID NO: 2613 - RNA, 19 nt, Artificial Sequence
  Description of Artificial Sequence: Synthetic oligonucleotide
cacuggugcuauagaaauu

SEQ ID NO: 2614 - RNA, 19 nt, Artificial Sequence
  Description of Artificial Sequence: Synthetic oligonucleotide
aauuucuauagcaccagug

SEQ ID NO: 2615 - RNA, 19 nt, Artificial Sequence
  Description of Artificial Sequence: Synthetic oligonucleotide
cuggugcuauagaaauuga

SEQ ID NO: 2616 - RNA, 19 nt, Artificial Sequence
  Description of Artificial Sequence: Synthetic oligonucleotide
ucaauuucuauagcaccag

SEQ ID NO: 2617 - RNA, 19 nt, Artificial Sequence
  Description of Artificial Sequence: Synthetic oligonucleotide
ugcuauagaaauugagaug

SEQ ID NO: 2618 - RNA, 19 nt, Artificial Sequence
  Description of Artificial Sequence: Synthetic oligonucleotide
caucucaauuucuauagca

SEQ ID NO: 2619 - RNA, 19 nt, Artificial Sequence
  Description of Artificial Sequence: Synthetic oligonucleotide
gcuauagaaauugagaugc

SEQ ID NO: 2620 - RNA, 19 nt, Artificial Sequence
  Description of Artificial Sequence: Synthetic oligonucleotide
gcaucucaauuucuauagc

SEQ ID NO: 2621 - RNA, 19 nt, Artificial Sequence
  Description of Artificial Sequence: Synthetic oligonucleotide
cuauagaaauugagaugcc

SEQ ID NO: 2622 - RNA, 19 nt, Artificial Sequence
  Description of Artificial Sequence: Synthetic oligonucleotide
ggcaucucaauuucuauag

SEQ ID NO: 2623 - RNA, 19 nt, Artificial Sequence
  Description of Artificial Sequence: Synthetic oligonucleotide
uauagaaauugagaugccc

SEQ ID NO: 2624 - RNA, 19 nt, Artificial Sequence
  Description of Artificial Sequence: Synthetic oligonucleotide
gggcaucucaauuucuaua

SEQ ID NO: 2625 - RNA, 19 nt, Artificial Sequence
  Description of Artificial Sequence: Synthetic oligonucleotide
auagaaauugagaugcccc

SEQ ID NO: 2626 - RNA, 19 nt, Artificial Sequence
  Description of Artificial Sequence: Synthetic oligonucleotide
ggggcaucucaauuucuau

SEQ ID NO: 2627 - RNA, 19 nt, Artificial Sequence
  Description of Artificial Sequence: Synthetic oligonucleotide
uagaaauugagaugccccc

SEQ ID NO: 2628 - RNA, 19 nt, Artificial Sequence
  Description of Artificial Sequence: Synthetic oligonucleotide
gggggcaucucaauuucua

SEQ ID NO: 2629 - RNA, 19 nt, Artificial Sequence
  Description of Artificial Sequence: Synthetic oligonucleotide
gaaauugagaugccccccc

SEQ ID NO: 2630 - RNA, 19 nt, Artificial Sequence
  Description of Artificial Sequence: Synthetic oligonucleotide
gggggggcaucucaauuuc

SEQ ID NO: 2631 - RNA, 19 nt, Artificial Sequence
  Description of Artificial Sequence: Synthetic oligonucleotide
aaauugagaugccccccca

SEQ ID NO: 2632 - RNA, 19 nt, Artificial Sequence
  Description of Artificial Sequence: Synthetic oligonucleotide
ugggggggcaucucaauuu

SEQ ID NO: 2633 - RNA, 19 nt, Artificial Sequence
  Description of Artificial Sequence: Synthetic oligonucleotide
gaugcccccccaggccagc

SEQ ID NO: 2634 - RNA, 19 nt, Artificial Sequence
  Description of Artificial Sequence: Synthetic oligonucleotide
gcuggccugggggggcauc

SEQ ID NO: 2635 - RNA, 19 nt, Artificial Sequence
  Description of Artificial Sequence: Synthetic oligonucleotide
cccccaggccagcaaaugu

SEQ ID NO: 2636 - RNA, 19 nt, Artificial Sequence
  Description of Artificial Sequence: Synthetic oligonucleotide
acauuugcuggccuggggg

SEQ ID NO: 2637 - RNA, 19 nt, Artificial Sequence
  Description of Artificial Sequence: Synthetic oligonucleotide
ccccaggccagcaaauguu

SEQ ID NO: 2638 - RNA, 19 nt, Artificial Sequence
  Description of Artificial Sequence: Synthetic oligonucleotide
aacauuugcuggccugggg

SEQ ID NO: 2639 - RNA, 19 nt, Artificial Sequence
  Description of Artificial Sequence: Synthetic oligonucleotide
uguuccuuuuuguucaaag

SEQ ID NO: 2640 - RNA, 19 nt, Artificial Sequence
  Description of Artificial Sequence: Synthetic oligonucleotide
cuuugaacaaaaaggaaca

SEQ ID NO: 2641 - RNA, 19 nt, Artificial Sequence
  Description of Artificial Sequence: Synthetic oligonucleotide
uccuuuuuguucaaagucu

SEQ ID NO: 2642 - RNA, 19 nt, Artificial Sequence
  Description of Artificial Sequence: Synthetic oligonucleotide
agacuuugaacaaaaagga

SEQ ID NO: 2643 - RNA, 19 nt, Artificial Sequence
  Description of Artificial Sequence: Synthetic oligonucleotide
uuuuuauuccuugauauuu

SEQ ID NO: 2644 - RNA, 19 nt, Artificial Sequence
  Description of Artificial Sequence: Synthetic oligonucleotide
aaauaucaaggaauaaaaa

SEQ ID NO: 2645 - RNA, 19 nt, Artificial Sequence
  Description of Artificial Sequence: Synthetic oligonucleotide
uguggauggggacuuguga

SEQ ID NO: 2646 - RNA, 19 nt, Artificial Sequence
  Description of Artificial Sequence: Synthetic oligonucleotide
ucacaaguccccauccaca

SEQ ID NO: 2647 - RNA, 19 nt, Artificial Sequence
  Description of Artificial Sequence: Synthetic oligonucleotide
ggauggggacuugugaauu

SEQ ID NO: 2648 - RNA, 19 nt, Artificial Sequence
  Description of Artificial Sequence: Synthetic oligonucleotide
aauucacaaguccccaucc

SEQ ID NO: 2649 - RNA, 19 nt, Artificial Sequence
  Description of Artificial Sequence: Synthetic oligonucleotide
gauggggacuugugaauuu

SEQ ID NO: 2650 - RNA, 19 nt, Artificial Sequence
  Description of Artificial Sequence: Synthetic oligonucleotide
aaauucacaaguccccauc

SEQ ID NO: 2651 - RNA, 19 nt, Artificial Sequence
  Description of Artificial Sequence: Synthetic oligonucleotide
auggggacuugugaauuuu

SEQ ID NO: 2652 - RNA, 19 nt, Artificial Sequence
  Description of Artificial Sequence: Synthetic oligonucleotide
aaaauucacaaguccccau

SEQ ID NO: 2653 - RNA, 19 nt, Artificial Sequence
  Description of Artificial Sequence: Synthetic oligonucleotide
gggacuugugaauuuuucu

SEQ ID NO: 2654 - RNA, 19 nt, Artificial Sequence
  Description of Artificial Sequence: Synthetic oligonucleotide
agaaaaauucacaaguccc

SEQ ID NO: 2655 - RNA, 19 nt, Artificial Sequence
  Description of Artificial Sequence: Synthetic oligonucleotide
ggacuugugaauuuuucua

SEQ ID NO: 2656 - RNA, 19 nt, Artificial Sequence
  Description of Artificial Sequence: Synthetic oligonucleotide
uagaaaaauucacaagucc

SEQ ID NO: 2657 - RNA, 19 nt, Artificial Sequence
  Description of Artificial Sequence: Synthetic oligonucleotide
ugaauuuuucuaaaggugc

SEQ ID NO: 2658 - RNA, 19 nt, Artificial Sequence
  Description of Artificial Sequence: Synthetic oligonucleotide
gcaccuuuagaaaaauuca

SEQ ID NO: 2659 - RNA, 19 nt, Artificial Sequence
  Description of Artificial Sequence: Synthetic oligonucleotide
aaggugcuauuuaacaugg

SEQ ID NO: 2660 - RNA, 19 nt, Artificial Sequence
  Description of Artificial Sequence: Synthetic oligonucleotide
ccauguuaaauagcaccuu

SEQ ID NO: 2661 - RNA, 19 nt, Artificial Sequence
  Description of Artificial Sequence: Synthetic oligonucleotide
aggugcuauuuaacauggg

SEQ ID NO: 2662 - RNA, 19 nt, Artificial Sequence
  Description of Artificial Sequence: Synthetic oligonucleotide
cccauguuaaauagcaccu

SEQ ID NO: 2663 - RNA, 19 nt, Artificial Sequence
  Description of Artificial Sequence: Synthetic oligonucleotide
ggugcuauuuaacauggga

SEQ ID NO: 2664 - RNA, 19 nt, Artificial Sequence
  Description of Artificial Sequence: Synthetic oligonucleotide
ucccauguuaaauagcacc

SEQ ID NO: 2665 - RNA, 19 nt, Artificial Sequence
  Description of Artificial Sequence: Synthetic oligonucleotide
gugcuauuuaacaugggag

SEQ ID NO: 2666 - RNA, 19 nt, Artificial Sequence
  Description of Artificial Sequence: Synthetic oligonucleotide
cucccauguuaaauagcac

SEQ ID NO: 2667 - RNA, 19 nt, Artificial Sequence
  Description of Artificial Sequence: Synthetic oligonucleotide
gcuauuuaacaugggagga

SEQ ID NO: 2668 - RNA, 19 nt, Artificial Sequence
  Description of Artificial Sequence: Synthetic oligonucleotide
uccucccauguuaaauagc

SEQ ID NO: 2669 - RNA, 19 nt, Artificial Sequence
  Description of Artificial Sequence: Synthetic oligonucleotide
cuauuuaacaugggaggag

SEQ ID NO: 2670 - RNA, 19 nt, Artificial Sequence
  Description of Artificial Sequence: Synthetic oligonucleotide
cuccucccauguuaaauag

SEQ ID NO: 2671 - RNA, 19 nt, Artificial Sequence
  Description of Artificial Sequence: Synthetic oligonucleotide
uauuuaacaugggaggaga

SEQ ID NO: 2672 - RNA, 19 nt, Artificial Sequence
  Description of Artificial Sequence: Synthetic oligonucleotide
ucuccucccauguuaaaua

SEQ ID NO: 2673 - RNA, 19 nt, Artificial Sequence
  Description of Artificial Sequence: Synthetic oligonucleotide
uuaacaugggaggagagcg

SEQ ID NO: 2674 - RNA, 19 nt, Artificial Sequence
  Description of Artificial Sequence: Synthetic oligonucleotide
cgcucuccucccauguuaa

SEQ ID NO: 2675 - RNA, 19 nt, Artificial Sequence
  Description of Artificial Sequence: Synthetic oligonucleotide
uaacaugggaggagagcgu

SEQ ID NO: 2676 - RNA, 19 nt, Artificial Sequence
  Description of Artificial Sequence: Synthetic oligonucleotide
acgcucuccucccauguua

SEQ ID NO: 2677 - RNA, 19 nt, Artificial Sequence
  Description of Artificial Sequence: Synthetic oligonucleotide
aacaugggaggagagcgug

SEQ ID NO: 2678 - RNA, 19 nt, Artificial Sequence
  Description of Artificial Sequence: Synthetic oligonucleotide
cacgcucuccucccauguu

SEQ ID NO: 2679 - RNA, 19 nt, Artificial Sequence
  Description of Artificial Sequence: Synthetic oligonucleotide
caugggaggagagcgugug

SEQ ID NO: 2680 - RNA, 19 nt, Artificial Sequence
  Description of Artificial Sequence: Synthetic oligonucleotide
cacacgcucuccucccaug

SEQ ID NO: 2681 - RNA, 19 nt, Artificial Sequence
  Description of Artificial Sequence: Synthetic oligonucleotide
augggaggagagcgugugc

SEQ ID NO: 2682 - RNA, 19 nt, Artificial Sequence
  Description of Artificial Sequence: Synthetic oligonucleotide
gcacacgcucuccucccau

SEQ ID NO: 2683 - RNA, 19 nt, Artificial Sequence
  Description of Artificial Sequence: Synthetic oligonucleotide
ggaggagagcgugugcggc

SEQ ID NO: 2684 - RNA, 19 nt, Artificial Sequence
  Description of Artificial Sequence: Synthetic oligonucleotide
gccgcacacgcucuccucc

SEQ ID NO: 2685 - RNA, 19 nt, Artificial Sequence
  Description of Artificial Sequence: Synthetic oligonucleotide
gaggagagcgugugcggcu

SEQ ID NO: 2686 - RNA, 19 nt, Artificial Sequence
  Description of Artificial Sequence: Synthetic oligonucleotide
agccgcacacgcucuccuc

SEQ ID NO: 2687 - RNA, 19 nt, Artificial Sequence
  Description of Artificial Sequence: Synthetic oligonucleotide
aggagagcgugugcggcuc

SEQ ID NO: 2688 - RNA, 19 nt, Artificial Sequence
  Description of Artificial Sequence: Synthetic oligonucleotide
gagccgcacacgcucuccu

SEQ ID NO: 2689 - RNA, 19 nt, Artificial Sequence
  Description of Artificial Sequence: Synthetic oligonucleotide
uccaccugccucuggcuuc

SEQ ID NO: 2690 - RNA, 19 nt, Artificial Sequence
  Description of Artificial Sequence: Synthetic oligonucleotide
gaagccagaggcaggugga

SEQ ID NO: 2691 - RNA, 19 nt, Artificial Sequence
  Description of Artificial Sequence: Synthetic oligonucleotide
caggccucugcucuccgac

SEQ ID NO: 2692 - RNA, 19 nt, Artificial Sequence
  Description of Artificial Sequence: Synthetic oligonucleotide
gucggagagcagaggccug

SEQ ID NO: 2693 - RNA, 19 nt, Artificial Sequence
  Description of Artificial Sequence: Synthetic oligonucleotide
aggccucugcucuccgacc

SEQ ID NO: 2694 - RNA, 19 nt, Artificial Sequence
  Description of Artificial Sequence: Synthetic oligonucleotide
ggucggagagcagaggccu

SEQ ID NO: 2695 - RNA, 19 nt, Artificial Sequence
  Description of Artificial Sequence: Synthetic oligonucleotide
ggccucugcucuccgaccu

SEQ ID NO: 2696 - RNA, 19 nt, Artificial Sequence
  Description of Artificial Sequence: Synthetic oligonucleotide
aggucggagagcagaggcc

SEQ ID NO: 2697 - RNA, 19 nt, Artificial Sequence
  Description of Artificial Sequence: Synthetic oligonucleotide
gccucugcucuccgaccuc

SEQ ID NO: 2698 - RNA, 19 nt, Artificial Sequence
  Description of Artificial Sequence: Synthetic oligonucleotide
gaggucggagagcagaggc

SEQ ID NO: 2699 - RNA, 19 nt, Artificial Sequence
  Description of Artificial Sequence: Synthetic oligonucleotide
cucugcucuccgaccucuc

SEQ ID NO: 2700 - RNA, 19 nt, Artificial Sequence
  Description of Artificial Sequence: Synthetic oligonucleotide
gagaggucggagagcagag

SEQ ID NO: 2701 - RNA, 19 nt, Artificial Sequence
  Description of Artificial Sequence: Synthetic oligonucleotide
uccgaccucucuccucuga

SEQ ID NO: 2702 - RNA, 19 nt, Artificial Sequence
  Description of Artificial Sequence: Synthetic oligonucleotide
ucagaggagagaggucgga

SEQ ID NO: 2703 - RNA, 19 nt, Artificial Sequence
  Description of Artificial Sequence: Synthetic oligonucleotide
gaccucucuccucugaaac

SEQ ID NO: 2704 - RNA, 19 nt, Artificial Sequence
  Description of Artificial Sequence: Synthetic oligonucleotide
guuucagaggagagagguc

SEQ ID NO: 2705 - RNA, 19 nt, Artificial Sequence
  Description of Artificial Sequence: Synthetic oligonucleotide
cucuccucugaaacccucc

SEQ ID NO: 2706 - RNA, 19 nt, Artificial Sequence
  Description of Artificial Sequence: Synthetic oligonucleotide
ggaggguuucagaggagag

SEQ ID NO: 2707 - RNA, 19 nt, Artificial Sequence
  Description of Artificial Sequence: Synthetic oligonucleotide
ucuccucugaaacccuccu

SEQ ID NO: 2708 - RNA, 19 nt, Artificial Sequence
  Description of Artificial Sequence: Synthetic oligonucleotide
aggaggguuucagaggaga

SEQ ID NO: 2709 - RNA, 19 nt, Artificial Sequence
  Description of Artificial Sequence: Synthetic oligonucleotide
ugaaacccuccuccacagc

SEQ ID NO: 2710 - RNA, 19 nt, Artificial Sequence
  Description of Artificial Sequence: Synthetic oligonucleotide
gcuguggaggaggguuuca

SEQ ID NO: 2711 - RNA, 19 nt, Artificial Sequence
  Description of Artificial Sequence: Synthetic oligonucleotide
agcccauccucccggcucc

SEQ ID NO: 2712 - RNA, 19 nt, Artificial Sequence
  Description of Artificial Sequence: Synthetic oligonucleotide
ggagccgggaggaugggcu

SEQ ID NO: 2713 - RNA, 19 nt, Artificial Sequence
  Description of Artificial Sequence: Synthetic oligonucleotide
cucccggcucccuccuagu

SEQ ID NO: 2714 - RNA, 19 nt, Artificial Sequence
  Description of Artificial Sequence: Synthetic oligonucleotide
acuaggagggagccgggag

SEQ ID NO: 2715 - RNA, 19 nt, Artificial Sequence
  Description of Artificial Sequence: Synthetic oligonucleotide
ucccggcucccuccuaguc

SEQ ID NO: 2716 - RNA, 19 nt, Artificial Sequence
  Description of Artificial Sequence: Synthetic oligonucleotide
gacuaggagggagccggga

SEQ ID NO: 2717 - RNA, 19 nt, Artificial Sequence
  Description of Artificial Sequence: Synthetic oligonucleotide
ccggcucccuccuagucug

SEQ ID NO: 2718 - RNA, 19 nt, Artificial Sequence
  Description of Artificial Sequence: Synthetic oligonucleotide
cagacuaggagggagccgg

SEQ ID NO: 2719 - RNA, 19 nt, Artificial Sequence
  Description of Artificial Sequence: Synthetic oligonucleotide
cggcucccuccuagucugu

SEQ ID NO: 2720 - RNA, 19 nt, Artificial Sequence
  Description of Artificial Sequence: Synthetic oligonucleotide
acagacuaggagggagccg

SEQ ID NO: 2721 - RNA, 19 nt, Artificial Sequence
  Description of Artificial Sequence: Synthetic oligonucleotide
ggcucccuccuagucuguc

SEQ ID NO: 2722 - RNA, 19 nt, Artificial Sequence
  Description of Artificial Sequence: Synthetic oligonucleotide
gacagacuaggagggagcc

SEQ ID NO: 2723 - RNA, 19 nt, Artificial Sequence
  Description of Artificial Sequence: Synthetic oligonucleotide
gcucccuccuagucugucc

SEQ ID NO: 2724 - RNA, 19 nt, Artificial Sequence
  Description of Artificial Sequence: Synthetic oligonucleotide
ggacagacuaggagggagc

SEQ ID NO: 2725 - RNA, 19 nt, Artificial Sequence
  Description of Artificial Sequence: Synthetic oligonucleotide
cucccuccuagucuguccu

SEQ ID NO: 2726 - RNA, 19 nt, Artificial Sequence
  Description of Artificial Sequence: Synthetic oligonucleotide
aggacagacuaggagggag

SEQ ID NO: 2727 - RNA, 19 nt, Artificial Sequence
  Description of Artificial Sequence: Synthetic oligonucleotide
uccuagucuguccugcguc

SEQ ID NO: 2728 - RNA, 19 nt, Artificial Sequence
  Description of Artificial Sequence: Synthetic oligonucleotide
gacgcaggacagacuagga

SEQ ID NO: 2729 - RNA, 19 nt, Artificial Sequence
  Description of Artificial Sequence: Synthetic oligonucleotide
ccuagucuguccugcgucc

SEQ ID NO: 2730 - RNA, 19 nt, Artificial Sequence
  Description of Artificial Sequence: Synthetic oligonucleotide
ggacgcaggacagacuagg

SEQ ID NO: 2731 - RNA, 19 nt, Artificial Sequence
  Description of Artificial Sequence: Synthetic oligonucleotide
uagucuguccugcguccuc

SEQ ID NO: 2732 - RNA, 19 nt, Artificial Sequence
  Description of Artificial Sequence: Synthetic oligonucleotide
gaggacgcaggacagacua

SEQ ID NO: 2733 - RNA, 19 nt, Artificial Sequence
  Description of Artificial Sequence: Synthetic oligonucleotide
agucuguccugcguccucu

SEQ ID NO: 2734 - RNA, 19 nt, Artificial Sequence
  Description of Artificial Sequence: Synthetic oligonucleotide
agaggacgcaggacagacu

SEQ ID NO: 2735 - RNA, 19 nt, Artificial Sequence
  Description of Artificial Sequence: Synthetic oligonucleotide
uguccugcguccucugucc

SEQ ID NO: 2736 - RNA, 19 nt, Artificial Sequence
  Description of Artificial Sequence: Synthetic oligonucleotide
ggacagaggacgcaggaca

SEQ ID NO: 2737 - RNA, 19 nt, Artificial Sequence
  Description of Artificial Sequence: Synthetic oligonucleotide
uccugcguccucugucccc

SEQ ID NO: 2738 - RNA, 19 nt, Artificial Sequence
  Description of Artificial Sequence: Synthetic oligonucleotide
ggggacagaggacgcagga

SEQ ID NO: 2739 - RNA, 19 nt, Artificial Sequence
  Description of Artificial Sequence: Synthetic oligonucleotide
guccucuguccccggguuu

SEQ ID NO: 2740 - RNA, 19 nt, Artificial Sequence
  Description of Artificial Sequence: Synthetic oligonucleotide
aaacccggggacagaggac

SEQ ID NO: 2741 - RNA, 19 nt, Artificial Sequence
  Description of Artificial Sequence: Synthetic oligonucleotide
ccucuguccccggguuuca

SEQ ID NO: 2742 - RNA, 19 nt, Artificial Sequence
  Description of Artificial Sequence: Synthetic oligonucleotide
ugaaacccggggacagagg

SEQ ID NO: 2743 - RNA, 19 nt, Artificial Sequence
  Description of Artificial Sequence: Synthetic oligonucleotide
cucuguccccggguuucag

SEQ ID NO: 2744 - RNA, 19 nt, Artificial Sequence
  Description of Artificial Sequence: Synthetic oligonucleotide
cugaaacccggggacagag

SEQ ID NO: 2745 - RNA, 19 nt, Artificial Sequence
  Description of Artificial Sequence: Synthetic oligonucleotide
cuguccccggguuucagag

SEQ ID NO: 2746 - RNA, 19 nt, Artificial Sequence
  Description of Artificial Sequence: Synthetic oligonucleotide
cucugaaacccggggacag

SEQ ID NO: 2747 - RNA, 19 nt, Artificial Sequence
  Description of Artificial Sequence: Synthetic oligonucleotide
uguccccggguuucagaga

SEQ ID NO: 2748 - RNA, 19 nt, Artificial Sequence
  Description of Artificial Sequence: Synthetic oligonucleotide
ucucugaaacccggggaca

SEQ ID NO: 2749 - RNA, 19 nt, Artificial Sequence
  Description of Artificial Sequence: Synthetic oligonucleotide
guccccggguuucagagac

SEQ ID NO: 2750 - RNA, 19 nt, Artificial Sequence
  Description of Artificial Sequence: Synthetic oligonucleotide
gucucugaaacccggggac

SEQ ID NO: 2751 - RNA, 19 nt, Artificial Sequence
  Description of Artificial Sequence: Synthetic oligonucleotide
uucagagacaacuucccaa

SEQ ID NO: 2752 - RNA, 19 nt, Artificial Sequence
  Description of Artificial Sequence: Synthetic oligonucleotide
uugggaaguugucucugaa

SEQ ID NO: 2753 - RNA, 19 nt, Artificial Sequence
  Description of Artificial Sequence: Synthetic oligonucleotide
guuuuucccccuaggggug

SEQ ID NO: 2754 - RNA, 19 nt, Artificial Sequence
  Description of Artificial Sequence: Synthetic oligonucleotide
caccccuagggggaaaaac

SEQ ID NO: 2755 - RNA, 19 nt, Artificial Sequence
  Description of Artificial Sequence: Synthetic oligonucleotide
uuuuucccccuaggggugg

SEQ ID NO: 2756 - RNA, 19 nt, Artificial Sequence
  Description of Artificial Sequence: Synthetic oligonucleotide
ccaccccuagggggaaaaa

SEQ ID NO: 2757 - RNA, 19 nt, Artificial Sequence
  Description of Artificial Sequence: Synthetic oligonucleotide
ugggaggaagcaaaagacu

SEQ ID NO: 2758 - RNA, 19 nt, Artificial Sequence
  Description of Artificial Sequence: Synthetic oligonucleotide
agucuuuugcuuccuccca

SEQ ID NO: 2759 - RNA, 19 nt, Artificial Sequence
  Description of Artificial Sequence: Synthetic oligonucleotide
ggaagcaaaagacucugua

SEQ ID NO: 2760 - RNA, 19 nt, Artificial Sequence
  Description of Artificial Sequence: Synthetic oligonucleotide
uacagagucuuuugcuucc

SEQ ID NO: 2761 - RNA, 19 nt, Artificial Sequence
  Description of Artificial Sequence: Synthetic oligonucleotide
aaaagacucuguaccuauu

SEQ ID NO: 2762 - RNA, 19 nt, Artificial Sequence
  Description of Artificial Sequence: Synthetic oligonucleotide
aauagguacagagucuuuu

SEQ ID NO: 2763 - RNA, 19 nt, Artificial Sequence
  Description of Artificial Sequence: Synthetic oligonucleotide
aaagacucuguaccuauuu

SEQ ID NO: 2764 - RNA, 19 nt, Artificial Sequence
  Description of Artificial Sequence: Synthetic oligonucleotide
aaauagguacagagucuuu

SEQ ID NO: 2765 - RNA, 19 nt, Artificial Sequence
  Description of Artificial Sequence: Synthetic oligonucleotide
aagacucuguaccuauuuu

SEQ ID NO: 2766 - RNA, 19 nt, Artificial Sequence
  Description of Artificial Sequence: Synthetic oligonucleotide
aaaauagguacagagucuu

SEQ ID NO: 2767 - RNA, 19 nt, Artificial Sequence
  Description of Artificial Sequence: Synthetic oligonucleotide
gacucuguaccuauuuugu

SEQ ID NO: 2768 - RNA, 19 nt, Artificial Sequence
  Description of Artificial Sequence: Synthetic oligonucleotide
acaaaauagguacagaguc

SEQ ID NO: 2769 - RNA, 19 nt, Artificial Sequence
  Description of Artificial Sequence: Synthetic oligonucleotide
cucuguaccuauuuuguau

SEQ ID NO: 2770 - RNA, 19 nt, Artificial Sequence
  Description of Artificial Sequence: Synthetic oligonucleotide
auacaaaauagguacagag

SEQ ID NO: 2771 - RNA, 19 nt, Artificial Sequence
  Description of Artificial Sequence: Synthetic oligonucleotide
uauaauaauuugagauguu

SEQ ID NO: 2772 - RNA, 19 nt, Artificial Sequence
  Description of Artificial Sequence: Synthetic oligonucleotide
aacaucucaaauuauuaua

SEQ ID NO: 2773 - RNA, 19 nt, Artificial Sequence
  Description of Artificial Sequence: Synthetic oligonucleotide
auaauaauuugagauguuu

SEQ ID NO: 2774 - RNA, 19 nt, Artificial Sequence
  Description of Artificial Sequence: Synthetic oligonucleotide
aaacaucucaaauuauuau

SEQ ID NO: 2775 - RNA, 19 nt, Artificial Sequence
  Description of Artificial Sequence: Synthetic oligonucleotide
auuauuuugauugcuggaa

SEQ ID NO: 2776 - RNA, 19 nt, Artificial Sequence
  Description of Artificial Sequence: Synthetic oligonucleotide
uuccagcaaucaaaauaau

SEQ ID NO: 2777 - RNA, 19 nt, Artificial Sequence
  Description of Artificial Sequence: Synthetic oligonucleotide
uugauugcuggaauaaagc

SEQ ID NO: 2778 - RNA, 19 nt, Artificial Sequence
  Description of Artificial Sequence: Synthetic oligonucleotide
gcuuuauuccagcaaucaa

SEQ ID NO: 2779 - RNA, 19 nt, Artificial Sequence
  Description of Artificial Sequence: Synthetic oligonucleotide
gauugcuggaauaaagcau

SEQ ID NO: 2780 - RNA, 19 nt, Artificial Sequence
  Description of Artificial Sequence: Synthetic oligonucleotide
augcuuuauuccagcaauc

SEQ ID NO: 2781 - RNA, 19 nt, Artificial Sequence
  Description of Artificial Sequence: Synthetic oligonucleotide
auugcuggaauaaagcaug

SEQ ID NO: 2782 - RNA, 19 nt, Artificial Sequence
  Description of Artificial Sequence: Synthetic oligonucleotide
caugcuuuauuccagcaau

SEQ ID NO: 2783 - RNA, 19 nt, Artificial Sequence
  Description of Artificial Sequence: Synthetic oligonucleotide
uugcuggaauaaagcaugu

SEQ ID NO: 2784 - RNA, 19 nt, Artificial Sequence
  Description of Artificial Sequence: Synthetic oligonucleotide
acaugcuuuauuccagcaa

SEQ ID NO: 2785 - RNA, 19 nt, Artificial Sequence
  Description of Artificial Sequence: Synthetic oligonucleotide
gaauaaagcauguggaaau

SEQ ID NO: 2786 - RNA, 19 nt, Artificial Sequence
  Description of Artificial Sequence: Synthetic oligonucleotide
auuuccacaugcuuuauuc

SEQ ID NO: 2787 - RNA, 19 nt, Artificial Sequence
  Description of Artificial Sequence: Synthetic oligonucleotide
gcauguggaaaugacccaa

SEQ ID NO: 2788 - RNA, 19 nt, Artificial Sequence
  Description of Artificial Sequence: Synthetic oligonucleotide
uugggucauuuccacaugc

SEQ ID NO: 2789 - RNA, 19 nt, Artificial Sequence
  Description of Artificial Sequence: Synthetic oligonucleotide
guggaaaugacccaaacau

SEQ ID NO: 2790 - RNA, 19 nt, Artificial Sequence
  Description of Artificial Sequence: Synthetic oligonucleotide
auguuugggucauuuccac

SEQ ID NO: 2791 - RNA, 19 nt, Artificial Sequence
  Description of Artificial Sequence: Synthetic oligonucleotide
uggaaaugacccaaacaua

SEQ ID NO: 2792 - RNA, 19 nt, Artificial Sequence
  Description of Artificial Sequence: Synthetic oligonucleotide
uauguuugggucauuucca

SEQ ID NO: 2793 - RNA, 19 nt, Artificial Sequence
  Description of Artificial Sequence: Synthetic oligonucleotide
auauguucuucaauacguc

SEQ ID NO: 2794 - RNA, 19 nt, Artificial Sequence
  Description of Artificial Sequence: Synthetic oligonucleotide
gacguauugaagaacauau

SEQ ID NO: 2795 - RNA, 19 nt, Artificial Sequence
  Description of Artificial Sequence: Synthetic oligonucleotide
uauauguucuucaauacgu

SEQ ID NO: 2796 - RNA, 19 nt, Artificial Sequence
  Description of Artificial Sequence: Synthetic oligonucleotide
acguauugaagaacauaua

SEQ ID NO: 2797 - RNA, 19 nt, Artificial Sequence
  Description of Artificial Sequence: Synthetic oligonucleotide
uucuagugcugacgcccgg

SEQ ID NO: 2798 - RNA, 19 nt, Artificial Sequence
  Description of Artificial Sequence: Synthetic oligonucleotide
ccgggcgucagcacuagaa

SEQ ID NO: 2799 - RNA, 19 nt, Artificial Sequence
  Description of Artificial Sequence: Synthetic oligonucleotide
uguccaaacuaaggcucgc

SEQ ID NO: 2800 - RNA, 19 nt, Artificial Sequence
  Description of Artificial Sequence: Synthetic oligonucleotide
gcgagccuuaguuuggaca

SEQ ID NO: 2801 - RNA, 19 nt, Artificial Sequence
  Description of Artificial Sequence: Synthetic oligonucleotide
guccaaacuaaggcucgcc

SEQ ID NO: 2802 - RNA, 19 nt, Artificial Sequence
  Description of Artificial Sequence: Synthetic oligonucleotide
ggcgagccuuaguuuggac

SEQ ID NO: 2803 - RNA, 19 nt, Artificial Sequence
  Description of Artificial Sequence: Synthetic oligonucleotide
aacagcacccgcgaccggg

SEQ ID NO: 2804 - RNA, 19 nt, Artificial Sequence
  Description of Artificial Sequence: Synthetic oligonucleotide
cccggucgcgggugcuguu

SEQ ID NO: 2805 - RNA, 19 nt, Artificial Sequence
  Description of Artificial Sequence: Synthetic oligonucleotide
ucacccgcgugcuaauggu

SEQ ID NO: 2806 - RNA, 19 nt, Artificial Sequence
  Description of Artificial Sequence: Synthetic oligonucleotide
accauuagcacgcggguga

SEQ ID NO: 2807 - RNA, 19 nt, Artificial Sequence
  Description of Artificial Sequence: Synthetic oligonucleotide
gcaacaauuccuggcguua

SEQ ID NO: 2808 - RNA, 19 nt, Artificial Sequence
  Description of Artificial Sequence: Synthetic oligonucleotide
uaacgccaggaauuguugc

SEQ ID NO: 2809 - RNA, 19 nt, Artificial Sequence
  Description of Artificial Sequence: Synthetic oligonucleotide
acagcacccgcgaccgggu

SEQ ID NO: 2810 - RNA, 19 nt, Artificial Sequence
  Description of Artificial Sequence: Synthetic oligonucleotide
acccggucgcgggugcugu

SEQ ID NO: 2811 - RNA, 19 nt, Artificial Sequence
  Description of Artificial Sequence: Synthetic oligonucleotide
aucgaagccauccguggcc

SEQ ID NO: 2812 - RNA, 19 nt, Artificial Sequence
  Description of Artificial Sequence: Synthetic oligonucleotide
ggccacggauggcuucgau

SEQ ID NO: 2813 - RNA, 19 nt, Artificial Sequence
  Description of Artificial Sequence: Synthetic oligonucleotide
aauacgucagacauucggg

SEQ ID NO: 2814 - RNA, 19 nt, Artificial Sequence
  Description of Artificial Sequence: Synthetic oligonucleotide
cccgaaugucugacguauu

SEQ ID NO: 2815 - RNA, 19 nt, Artificial Sequence
  Description of Artificial Sequence: Synthetic oligonucleotide
caauacgucagacauucgg

SEQ ID NO: 2816 - RNA, 19 nt, Artificial Sequence
  Description of Artificial Sequence: Synthetic oligonucleotide
ccgaaugucugacguauug

SEQ ID NO: 2817 - RNA, 19 nt, Artificial Sequence
  Description of Artificial Sequence: Synthetic oligonucleotide
ggacuaucaccuaccuuuc

SEQ ID NO: 2818 - RNA, 19 nt, Artificial Sequence
  Description of Artificial Sequence: Synthetic oligonucleotide
gaaagguaggugauagucc

SEQ ID NO: 2819 - RNA, 19 nt, Artificial Sequence
  Description of Artificial Sequence: Synthetic oligonucleotide
cgcaucgaagccauccgug

SEQ ID NO: 2820 - RNA, 19 nt, Artificial Sequence
  Description of Artificial Sequence: Synthetic oligonucleotide
cacggauggcuucgaugcg

SEQ ID NO: 2821 - RNA, 19 nt, Artificial Sequence
  Description of Artificial Sequence: Synthetic oligonucleotide
uuauucaggacuaucaccu

SEQ ID NO: 2822 - RNA, 19 nt, Artificial Sequence
  Description of Artificial Sequence: Synthetic oligonucleotide
aggugauaguccugaauaa

SEQ ID NO: 2823 - RNA, 19 nt, Artificial Sequence
  Description of Artificial Sequence: Synthetic oligonucleotide
aaugguggaccgcaacaac

SEQ ID NO: 2824 - RNA, 19 nt, Artificial Sequence
  Description of Artificial Sequence: Synthetic oligonucleotide
guuguugcgguccaccauu

SEQ ID NO: 2825 - RNA, 19 nt, Artificial Sequence
  Description of Artificial Sequence: Synthetic oligonucleotide
cuacuacgugggucgcaag

SEQ ID NO: 2826 - RNA, 19 nt, Artificial Sequence
  Description of Artificial Sequence: Synthetic oligonucleotide
cuugcgacccacguaguag

SEQ ID NO: 2827 - RNA, 19 nt, Artificial Sequence
  Description of Artificial Sequence: Synthetic oligonucleotide
cuucuagugcugacgcccg

SEQ ID NO: 2828 - RNA, 19 nt, Artificial Sequence
  Description of Artificial Sequence: Synthetic oligonucleotide
cgggcgucagcacuagaag

SEQ ID NO: 2829 - RNA, 19 nt, Artificial Sequence
  Description of Artificial Sequence: Synthetic oligonucleotide
guucuucaauacgucagac

SEQ ID NO: 2830 - RNA, 19 nt, Artificial Sequence
  Description of Artificial Sequence: Synthetic oligonucleotide
gucugacguauugaagaac

SEQ ID NO: 2831 - RNA, 19 nt, Artificial Sequence
  Description of Artificial Sequence: Synthetic oligonucleotide
ccccacugauacgccugag

SEQ ID NO: 2832 - RNA, 19 nt, Artificial Sequence
  Description of Artificial Sequence: Synthetic oligonucleotide
cucaggcguaucagugggg

SEQ ID NO: 2833 - RNA, 19 nt, Artificial Sequence
  Description of Artificial Sequence: Synthetic oligonucleotide
ccaaacuaaggcucgccag

SEQ ID NO: 2834 - RNA, 19 nt, Artificial Sequence
  Description of Artificial Sequence: Synthetic oligonucleotide
cuggcgagccuuaguuugg

SEQ ID NO: 2835 - RNA, 19 nt, Artificial Sequence
  Description of Artificial Sequence: Synthetic oligonucleotide
cucuaccagaaauauagca

SEQ ID NO: 2836 - RNA, 19 nt, Artificial Sequence
  Description of Artificial Sequence: Synthetic oligonucleotide
ugcuauauuucugguagag

SEQ ID NO: 2837 - RNA, 19 nt, Artificial Sequence
  Description of Artificial Sequence: Synthetic oligonucleotide
uucuucaauacgucagaca

SEQ ID NO: 2838 - RNA, 19 nt, Artificial Sequence
  Description of Artificial Sequence: Synthetic oligonucleotide
ugucugacguauugaagaa

SEQ ID NO: 2839 - RNA, 19 nt, Artificial Sequence
  Description of Artificial Sequence: Synthetic oligonucleotide
ugguggaccgcaacaacgc

SEQ ID NO: 2840 - RNA, 19 nt, Artificial Sequence
  Description of Artificial Sequence: Synthetic oligonucleotide
gcguuguugcgguccacca

SEQ ID NO: 2841 - RNA, 19 nt, Artificial Sequence
  Description of Artificial Sequence: Synthetic oligonucleotide
gcuguacauugacuuuagg

SEQ ID NO: 2842 - RNA, 19 nt, Artificial Sequence
  Description of Artificial Sequence: Synthetic oligonucleotide
ccuaaagucaauguacagc

SEQ ID NO: 2843 - RNA, 19 nt, Artificial Sequence
  Description of Artificial Sequence: Synthetic oligonucleotide
uuccuggcguuaccuuggu

SEQ ID NO: 2844 - RNA, 19 nt, Artificial Sequence
  Description of Artificial Sequence: Synthetic oligonucleotide
accaagguaacgccaggaa

SEQ ID NO: 2845 - RNA, 19 nt, Artificial Sequence
  Description of Artificial Sequence: Synthetic oligonucleotide
augguggaccgcaacaacg

SEQ ID NO: 2846 - RNA, 19 nt, Artificial Sequence
  Description of Artificial Sequence: Synthetic oligonucleotide
cguuguugcgguccaccau

SEQ ID NO: 2847 - RNA, 19 nt, Artificial Sequence
  Description of Artificial Sequence: Synthetic oligonucleotide
cuaaugguggaccgcaaca

SEQ ID NO: 2848 - RNA, 19 nt, Artificial Sequence
  Description of Artificial Sequence: Synthetic oligonucleotide
uguugcgguccaccauuag

SEQ ID NO: 2849 - RNA, 19 nt, Artificial Sequence
  Description of Artificial Sequence: Synthetic oligonucleotide
gcggugcucgcuuuguaca

SEQ ID NO: 2850 - RNA, 19 nt, Artificial Sequence
  Description of Artificial Sequence: Synthetic oligonucleotide
uguacaaagcgagcaccgc

SEQ ID NO: 2851 - RNA, 19 nt, Artificial Sequence
  Description of Artificial Sequence: Synthetic oligonucleotide
ucgaagccauccguggcca

SEQ ID NO: 2852 - RNA, 19 nt, Artificial Sequence
  Description of Artificial Sequence: Synthetic oligonucleotide
uggccacggauggcuucga

SEQ ID NO: 2853 - RNA, 19 nt, Artificial Sequence
  Description of Artificial Sequence: Synthetic oligonucleotide
uccuguccaaacuaaggcu

SEQ ID NO: 2854 - RNA, 19 nt, Artificial Sequence
  Description of Artificial Sequence: Synthetic oligonucleotide
agccuuaguuuggacagga

SEQ ID NO: 2855 - RNA, 19 nt, Artificial Sequence
  Description of Artificial Sequence: Synthetic oligonucleotide
cccacugauacgccugagu

SEQ ID NO: 2856 - RNA, 19 nt, Artificial Sequence
  Description of Artificial Sequence: Synthetic oligonucleotide
acucaggcguaucaguggg

SEQ ID NO: 2857 - RNA, 19 nt, Artificial Sequence
  Description of Artificial Sequence: Synthetic oligonucleotide
aaacuaaggcucgccaguc

SEQ ID NO: 2858 - RNA, 19 nt, Artificial Sequence
  Description of Artificial Sequence: Synthetic oligonucleotide
gacuggcgagccuuaguuu

SEQ ID NO: 2859 - RNA, 19 nt, Artificial Sequence
  Description of Artificial Sequence: Synthetic oligonucleotide
accuugguaaccggcugcu

SEQ ID NO: 2860 - RNA, 19 nt, Artificial Sequence
  Description of Artificial Sequence: Synthetic oligonucleotide
agcagccgguuaccaaggu

We claim:

1. A double-stranded ribonucleic acid (dsRNA) for inhibiting expression of COL1A1, wherein said dsRNA comprises a sense strand and an antisense strand, wherein the sense strand consists of SEQ ID NO: 53 and the antisense strand consists of SEQ ID NO: 54.

2. A double-stranded ribonucleic acid (dsRNA) for inhibiting expression of COL1A1, wherein said dsRNA comprises a modified sense strand and a modified antisense strand,
the sense strand comprising one of SEQ ID NOs:29, 33, 41, 45, 47, and 55, and the antisense strand comprising, respectively, one of SEQ ID NOs:30, 34, 42, 46, 48, and 56.

3. The dsRNA of claim 2, wherein each strand is no more than 30 nucleotides in length.

4. The dsRNA of claim 2, wherein at least one strand comprises a 3' overhang of at least 1 nucleotide.

5. The dsRNA of claim 2, further comprising a ligand.

6. A cell containing the dsRNA of claim 2.

7. A lipid formulation comprising the dsRNA of claim 2.

8. A vector encoding a dsRNA, wherein said dsRNA comprises a sense strand comprising a nucleobase sequence selected from the group consisting of SEQ ID NOs:29, 33, 41, 45, 47, and 55, an antisense strand comprising, respectively, a nucleobase sequence selected from the group consisting of SEQ ID NOs: 30, 34, 42, 46, 48, and 56, wherein the dsRNA is 30 or fewer base pairs in length, and wherein said dsRNA targets a COL1A1 mRNA for cleavage.

* * * * *